(12) United States Patent
Callen et al.

(10) Patent No.: US 7,759,093 B2
(45) Date of Patent: Jul. 20, 2010

(54) AMYLASES, NUCLEIC ACIDS ENCODING THEM AND METHODS FOR MAKING AND USING THEM

(75) Inventors: Walter Callen, San Diego, CA (US); Toby Richardson, San Diego, CA (US); Gerhard Frey, San Diego, CA (US); Kevin Gray, San Diego, CA (US); Janne S. Kerovuo, San Diego, CA (US); Malgorzata Slupska, San Diego, CA (US); Nelson Barton, San Diego, CA (US); Eileen O'Donoghue, San Diego, CA (US); Carl Miller, Raleigh, NC (US)

(73) Assignee: Verenium Corporation, San Diego, CA (US)

( * ) Notice: Subject to any disclaimer, the term of this patent is extended or adjusted under 35 U.S.C. 154(b) by 691 days.

(21) Appl. No.: 10/547,957

(22) PCT Filed: Mar. 8, 2004

(86) PCT No.: PCT/US2004/007096

§ 371 (c)(1),
(2), (4) Date: Jun. 30, 2006

(87) PCT Pub. No.: WO2004/091544

PCT Pub. Date: Oct. 28, 2004

(65) Prior Publication Data

US 2007/0157329 A1 Jul. 5, 2007

Related U.S. Application Data

(63) Continuation of application No. 10/385,305, filed on Mar. 6, 2003, now Pat. No. 7,560,126.

(60) Provisional application No. 60/459,014, filed on Mar. 28, 2003.

(51) Int. Cl.
*C12N 9/26* (2006.01)
*C12S 11/00* (2006.01)
*C12P 19/14* (2006.01)
*A23K 1/00* (2006.01)
*C12N 15/56* (2006.01)

(52) U.S. Cl. ............... 435/99; 435/201; 435/202; 435/174; 435/263; 435/264; 426/656; 426/48; 426/53; 426/592; 510/392; 424/50

(58) Field of Classification Search .................. None
See application file for complete search history.

(56) References Cited

U.S. PATENT DOCUMENTS 5,789,228 A 8/1998 Lam et al.
2003/0135885 A1 7/2003 Lanahan

FOREIGN PATENT DOCUMENTS

EP 0 648 843 4/1995
FR 2778412 11/1999
JP 09173077 7/1997
WO WO-97/44361 11/1997
WO WO-98/45417 10/1998
WO WO-00/58508 10/2000
WO WO-02/068589 9/2002
WO WO03012071 2/2003

OTHER PUBLICATIONS

GenBank Accession No. Y13601 (Jun. 1998.*
O'Neill et al., Mol. Gen. Genet. (1990) 221:235-244.
Giver and Arnold, Current Opinion in Chemical Biology (1998) 2:335-338.
Office Action for European Patent Application No. 02 723 192.7, mailed on Jul. 24, 2008, 7 pages.
Rubingh, Current Opinion in Biotechnology (1997) 8:417-422.
GENBANK Database, Accession No. AF017454, Jones et al. [Jun. 25, 2001].
Examiner's First Report for Australian Patent Application No. 2006207843, mailed on Sep. 8, 2008, 2 pages.
International Search Report for PCTUSO4/07096, mailed on Jul. 16, 2008, 9 pages.
Non-Final Office Action for U.S. Appl. No. 10/385,305, mailed on Jun. 25, 2008, 15 pages.
Richardson et al., J. Biol. Chem. (2002) 277(29):26501-26507.
UniProt—Swiss-Prot Protein Knowledgebase, Swiss Institute of Bioinformatics (SIB) et al., Glycosyl hydrolase families: classification and list of entries <http://www.expasy.ch/cgi-bin/lists?glycosid.txt> Release 55.5, Jun. 10, 2008.
Bork, Genome Research (2000) 10:348-400.
Broun et al., Science (1998) 282:1315-1317.
Database Genbank, US National Library of Medicine (Bethesda, MD, USA), No. AAY53917, Leveque et al., Mar. 13, 2000.
Database Genbank, US National Library of Medicine (Bethesda, MD, USA), No. AAW26131, Imanaka et al., Nov. 21, 1997.
Database Genbank, US National Library of Medicine (Bethesda, MD, USA), No. AAW34998, Lam et al., May 21, 1998.
Database Genbank, US National Library of Medicine (Bethesda, MD, USA), No. AAR72603, Asada et al., Oct. 25, 1995.
Database Genbank, US National Library of Medicine (Bethesda, MD, USA), No. AAR72602, Asada et al., Oct. 25, 1995.
Database Genbank, US National Library of Medicine (Bethesda, MD, USA), No. AF068255, Leveque et al., May 4, 2000.
Database Genbank, US National Library of Medicine (Bethesda, MD, USA), No. D83793, Tachibana et al., Feb. 1, 2000.
Database Genbank, US National Library of Medicine (Bethesda, MD, USA), No. E13334, Imanaka et al., Apr. 27, 1998.

(Continued)

*Primary Examiner*—Rebecca Prouty

(57) ABSTRACT

In one aspect, the invention is directed to polypeptides having an amylase activity, polynucleotides encoding the polypeptides, and methods for making and using these polynucleotides and polypeptides. In one aspect, the polypeptides of the invention can be used as amylases, for example, alpha amylases, to catalyze the hydrolysis of starch into sugars. In one aspect, the invention provides delayed release compositions comprising an desired ingredient coated by a latex polymer coating.

21 Claims, 163 Drawing Sheets

OTHER PUBLICATIONS

Database Uniprot 'Online! (2000). Alpha amylase-*Pyrococcus woesei*, XP002317659 retrieved from EBI, Database Accession No. Q9P9LO.
Dong et al., App. and Environ. Microbiol. (1997) 63(9):3569-3576.
Fox et al., Anal. Biochem. (1991) 195(1):93-96.
Guo et al., PNAS USA (2004) 101(25):9205-9210.
Jones et al., Journal of Applied Microbiology (1999) 86(1):93-107 XP002317658.
Jorgensen et al., J. of Biol. Chem. (1997) 272(26):16335-16342.
Leveque et al., FEMS Microbiol. Letts. (2000) 186(1):67-71.
Patent Abstracts of Japan (1997). JP 9173077 A 1997(11).
Seffernick et al., J. of Bacteriol. (2001) 183(8):2405-2410.
Supplementary European Search Report mailed Sep. 6, 2004 for European patent application No. EP02706401, 5 pages.
Supplementary Partial European Search Report mailed on Mar. 11, 2005, for European Patent application No. 02723192.7, based on PCT/US02/05068 filed on Feb. 21, 2002.
Tachibana et al., J. of Ferment. and Bioengin. (1996) 82(3):224-232.
Van De Loo et al., Proc. Natl. Acad. Sci. (1995) 92(15):6743-6747.
Witkowski et al., Biochemistry (1999) 38:11643-11650.
Wong et al., J. Agric. Food Chem. (2000) 48(10):4540-4543.
GenPept Database, Accession No. AAB87860, Jones et al. [2001].
GenPept Database, Accession No. ACC97877, Herlemann et al. [2008].
GenPept Database, Accession No. BAA21130, Tachibana et al. [2000].
Nigam et al., Enzyme Microbial Technology (1995) 17:770-778.
Non-Final Office Action for U.S. Appl. No. 11/621,543, mailed on May 13, 2009, 19 pages.
Office Action for Canadian Patent Application No. 2,438,884, mailed on Apr. 24, 2009, 8 pages.
Office Action for Japanese Patent Application No. 2002-568685, dated Jun. 1, 2009, 4 pages.
EP07869797.6—Supplementary EP Search Report—Sep. 29, 2009.
EP04718513.7—Supplementary EP Search Report—Oct. 5, 2009.
UNIPROT Database Accession No. Q4WIT7—*Aspergillus fumigatus* Jul. 5, 2005.
GENESEQ Accession No. ABU03040—Alpha Amylase—Jan. 21, 2003.
UNIPROT Accession No. Q8JZK3—Alpha Amylase—Oct. 1, 2002.
GENESEQ Accession No. ABQ80354 (2003)—Jiang.
GENESEQ Accession No. ABB80181 (2003)—Jiang.
EMBL Accession No. AR941925 (2006)—Lanahan.
Richardson—Journal of Biological Chemistry (2002)—277—26501-26507.

* cited by examiner

Figure 10: Alignments of the genes proposed to be used in reassembly

```
                            1                                                                              80
SEQ ID NO:114   (1)    ----AANLNGTLMQYFEWYMPNDGQHWKRLQNDSAYLAEHCITAVWIPPAYKGTS-QADVCYGAYDLYDLGEFHQKGTVR
SEQ ID NO:128   (1)    -QANTAPVNGTMMQYFEWDLPNDGTLWTKVKNEASSLSSLGITALWLPPAYKGTS-QGDVGYGVYDLYDLGEFNQKGTIR
SEQ ID NO:116   (1)    AKYSELEQGGVIMQAFYWDVPEGGIWWDTIRQKIPEWYDAGISAIWIPPASKGMGGAYSMGYDPYDYFDLGEFYQKGTVE 81                                                                             160
SEQ ID NO:114   (76)   TKYGTKGELQSAIKSLHSRDINVYGDVVINHKGGADATEDVTAVEVDPADRNRVISGEHRIKAWTHFEFPGRGSTYSDFK
SEQ ID NO:128   (79)   TKYGTKTQYLQAIQAAKSAGMQVYADVVFNHKAGADSTEWVDAVEVNPSNRNQETSGTYQIQAWTKFDFPGRGNTYSSFK
SEQ ID NO:116   (81)   TRFGSKEELVNMISTAHQYGIKVIADIVINHRAGGDLEWNPYVGDYTWTDFSKVASGKYKAEYMDFHPN----------

161                                                                            240
SEQ ID NO:114   (156)  WHWYHFDGTDWDESRKLNRIYKFQG--KAWDWEVSNENGNYDYLMYADIDYDHPDVAAEIKRWGTWYANELQLDGFRLDA
SEQ ID NO:128   (159)  WRWYHFDGTDWDESRKLNRIYKFRGTGKAWDWEVDTENGNYDYLMFADLDMDHPEVVTELKNWGTWYVNTTNVDGFRLDA
SEQ ID NO:116   (150)  ----NYSTSDEGTFGGFPDIDELVPFNQYWLWASNES-----------------------YAAYLRSIGIDAWRFDY 241                                                                            320
SEQ ID NO:114   (234)  VKEIKFSFLRDWVNHVREKTGKEMFTVAEYWQNDLGALENYLNKTNFNESVFDVPLHYQFHAASTQGGGYDMRKLLNG--
SEQ ID NO:128   (239)  VKEIKYSFFPDWLTHVRSQTRKNLFAVGEFWSYDVNKLHNYITKTSGTMSLFDAPLHNNFYTASKSSGYFDMRYLLNN--
SEQ ID NO:116   (200)  VKGYGAWVVKDWLSQWGG------WAVGEYWDTNVDALLNWAYSSG--AKVFDFPLYYKMDEAFDNKNIPALVYAIQNGE 321                                                                            400
SEQ ID NO:114   (312)  TVVSKHPLKAVTFVDNHDTQPCQSLESTVQTWFKPLAYAFILTRESCYPQVFYCDMYCTKCDSQ--REIPALKHKIEPIL
SEQ ID NO:128   (317)  TLMKDQPSLAVTLVDNHDTQPCQSLQSWVEPWFKPLAYAFILTRQECYPCVFYCDYYCIPKYN-----IPCLKSKIDPLL
SEQ ID NO:116   (272)  TVVSRDPFKAVTFVANHDTN---------IIWNKYPAYAFILTYE-GQPVIFYRDYEEWLNKD--------KLNNL---I 401                                                                            480
SEQ ID NO:114   (390)  KARKQYAYGAQHDYFDHHDIVGWTREGDSSVANSGLAALITDGPGGAKRMYVGRQNAGETWEDITGNRS--EPVVINSEG
SEQ ID NO:128   (392)  IARRDYAYGTQRDYIDHQDIIGWTREGIDSKPNSGLAALITDGPGGSKWMYVGKKHAGKVFYDLTGNRS--DTVTINADG
SEQ ID NO:116   (331)  WIFEHLAGGSTKILYYDDDELIFMREGYGDRPGL-ITYINLGSDWAERWVNVGSKFAGYTIEEYTGNLGGWVDRYVQYDG 481                                                                            560
SEQ ID NO:114   (468)  WGEFHVN---------GGSVSIYVQR------------------------------------------------------
SEQ ID NO:128   (470)  WGEFKVN---------GGSVSIWVAKTSQVTFTVNNATTISGQNVYVVGNIPELGNWNTANAIKMTPSSYPTWKATIALP
SEQ ID NO:116   (410)  WVKLTAPPEDPANGYYGYSVWSYAGVG-----------------------------------------------------

561                                          605
SEQ ID NO:114   (485)  ---------------------------------------------
SEQ ID NO:128   (541)  QGKAIEFKFIKKDQSGNVVWESIPNRTYTVPFLSTGSYTASWNVP
SEQ ID NO:116   (437)  ---------------------------------------------
```

```
                   1                                                              50
SEQ ID NO: 81   ---------- -------MKK FVALFITMFF VVSMAVV... ..AQPASAA K
       pyro    ---------- -------MKK FVALLITMFF VVSMAAV... ..AQPASAA K
       pyro2   ---------- ------VNIKK LTPLLTLLLF FI...VL... ..ASPVSAA K
       thermo  SESQCTATCT WRVVYMSAKK LLALLFVLAV LVGVAVIPAR VGIAPVSAG A
       thermo2 ---------- ---------- -------MA RKVLVALLVF LVVLSVSAV P
       Consensus ---------- ---------- ---------- ---------- ------SA- -

51                                                             100
SEQ ID NO: 81   YS..ELEEGG VIMQAFYWDV PGGGIWWDTI RSKIPEWYEA GISAIWIPP A
       pyro    YS..ELEEGG VIMQAFYWDV PAGGIWWDTI RSKIPEWYEA GISAIWIPP A
       pyro2   YL..ELEEGG VIMQAFYWDV PGGGIWWDHI RSKIPEWYEA GISAIWLPP P
       thermo  TSRPSLEEGG VIMQAFYWDV PAGGIWWDTI RSKIPDWASA GISAIWIPP A
       thermo2 AKAETLENGG VIMQAFYWDV PGGGIWWDTI AQKIPDWASA GISAIWIPP A
       Consensus -----LE-GG VIMQAFYWDV P-GGIWWD-I --KIP-W--A GISAIW-PP -
                Sense primer
                   101                                                            150
SEQ ID NO: 81   SKGMSGGYSM GYDPYDFFDL GEYNQKGTIE TRFGSKQELI NMINTAHAY G
       pyro    SKGMGGAYSM GYDPYDFFDL GEYNQKGTVE TRFGSKQELI NMINTAHAY G
       pyro2   SKGMSGGYSM GYDPYDYFDL GEYYQKGTVE TRFGSKEELV RLIQTAHAY G
       thermo  SKGMSGAYSM GYDPYDFFDL GEYYQKGTVE TRFGSKQELI NMINTAHSY G
       thermo2 SKGMSGGYSM GYDPYDFFDL GEYYQKGSVE TRFGSKEELV NMINTAHAH N
       Consensus SKGM-G-YSM GYDPYD-FDL GEY-QKG--E TRFGSK-EL- --I-TAH-- -

151                                                            200
SEQ ID NO: 81   IKVIADIVIN HRAGGDLEWN PFVGDYTWTD FSKVASGKYT ANYLDFHPN E
       pyro    IKVIADIVIN HRAGGDLEWN PFVGDYTWTD FSKVASGKYT ANYLDFHPN E
       pyro2   IKVIADVVIN HRAGGDLEWN PFVGDYTWTD FSKVASGKYT ANYLDFHPN E
       thermo  IKVIADIVIN HRAGGDLEWN PFTNSYTWTD FSKVASGKYT ANYLDFHPN E
       thermo2 MKVIADIVIN HRAGGDLEWN PFTNSYTWTD FSKVASGKYT ANYLDFHPN E
       Consensus -KVIAD-VIN HRAGGDLEWN PF---YTWTD FSKVASGKYT ANYLDFHPN E 201                                                            250
SEQ ID NO: 81   VKCCDEGTFG GFPDIAHEKS WDQHWLWASD ESYAAYLRSI GVDAWRFDY V
       pyro    VKCCDEGTFG GFPDIAHEKE WDQHWLWASD ESYAAYLRSI GVDAWRFDY V
       pyro2   LHCCDEGTFG GFPDICHHKE WDQYWLWKSN ESYAAYLRSI GFDGWRFDY V
       thermo  VKCCDEGTFG GFPDIAHEKS WDQYWLWASQ KSYAAYLRSI GIDAWRFDY V
       thermo2 LHAGDSGTFG GYPDICHDKS WDQHWLWASN ESYAAYLRSI GIDAWRFDY V
       Consensus ----D-GTFG G-PDI-H-K- WDQ-WLW-S- -SYAAYLRSI G-D-WRFDY V 251                                                            300
SEQ ID NO: 81   KGYGAWVVKD WLNWWGGWAV GEYWDTNVDA LLNWAYSSGA KVFDFPLYY K
       pyro    KGYGAWVVKD WLNWWGGWAV GEYWDTNVDA LLNWAYSSGA KVFDFPLYY K
       pyro2   KGYGAWVVRD WENWWGGWAV GEYWDTNVDA LLSWAYESGA KVFDFPLYY K
       thermo  KGYGAWVVKD WLKWW.ALAV GEYWDTNVDA LLNWAYSSGA KVFDFPLYY K
       thermo2 KGYAPWVVKN WLNRWGGWAV GEYWDTNVDA LLSWAYDSGA KVFDFPLYY K
       Consensus KGY--WVV-- WL--W---AV GEYWDTNVDA LL-WAY-SGA KVFDFPLYY K 301                                                            350
SEQ ID NO: 81   MDEAFDNKNI PALVSALQNG QTVVSRDPFK AVTFVANHDT DIIWNKYLA Y
       pyro    MDEAFDNTNI PALVDALQNG GTVVSRDPFK AVTFVANHDT DIIWNKYPA Y
       pyro2   MDEAFDNNNI PALVYALQNG QTVVSRDPFK AVTFVANHDT DIIWNKYPA Y
       thermo  MDEAFDNKNI PALVSALQNG QTVVSRDPFK AVTFVANHDT DIIWNKYPA Y
       thermo2 MDEAFDNNNI PALVDALKNG GTVVSRDPFK AVTFVANHDT NIIWNKYPA Y
       Consensus MDEAFDN-NI PALV-AL-NG -TVVSRDPFK AVTFVANHDT -IIWNKY-A Y
```

FIGURE 14A

```
                  351                                                          400
SEQ ID NO: 81     AFILTYEGQP VIFYRDYEEW LNKDRLNNLI WIHDHLAGGS TSIVYYDSDE
      pyro       AFILTYEGQP VIFYRDYEEW LNKDKLNNLI WIHDHLAGGS TSIVYYDSDE
      pyro2      AFILTYEGQP VIFYRDFEEW LNKDKLINLI WIHDHLAGGS TTIVYYDNDE
      thermo     AFILTYEGQP VIFYRDYEEW LNKDRLKNLI WIHNNLAGGS TSIVYYDNDE
      thermo2    AFILTYEGQP AIFYRDYEEW LNKDRLRNLI WIHDHLAGGS TDIIYYDSDE
      Consensus  AFILTYEGQP -IFYRD-EEW LNKD-L-NLI WIH--LAGGS T-I-YYD-DE 401                                                          450
SEQ ID NO: 81     MIFVRNGYGS KPGLITYINL GSSKVGRWVY VPKFAGACIH EYTGNLGGWV
      pyro       LIFVRNGDSK RPGLITYINL GSSKVGRWVY VPKFAGACIH EYTGNLGGWV
      pyro2      LIFVRNGDSR RPGLITYINL SPNWVGRWVY VPKFAGACIH EYTGNLGGWV
      thermo     LIFVRNGYGN KPGLITYINL GSSKVGRWVY VPKFAGSCIH EYTGNLGGWV
      thermo2    LIFVRNGYGD KPGLITYINL GSSKAGRWVY VPKFAGSCIH EYTGNLGGWI
      Consensus  -IFVRNG--- -PGLITYINL -----GRWVY VPKFAG-CIH EYTGNLGGW- 451              486
SEQ ID NO: 81     DKYVYSSGWV YFEAPAYDPA NGQYGYSVWS YCGVG*
      pyro       DKYVESSGWV YLEAPAYDPA SGQYGYTVWS YCGVG*
      pyro2      DKRVDSSGWV YLEAPPHDPA NGYYGYSVWS YCGVG*
      thermo     DKYVGSNGWV YLEAPAHDPA KGQYGYSVWS YCGVG*
      thermo2    DKWVDSSGRV YLEAPAHDPA NGQYGYSVWS YCGVG*
      Consensus  DK-V-S-G-V Y-EAP--DPA -G-YGY-VWS YCGVG*
                                                 Antisense primer
```

FIGURE 14A
(cont.)

```
                   1                                                              50
SEQ ID NO: 81      ---------- ---------- ----MKKFVA LFITMFFVVS MAVVAQPASA
      pyro         ---------- ---------- ----MKKFVA LLITMFFVVS MAAVAQPASA
SEQ ID NO: 73      ---------- ---------- ---------- ---------- ----------
      thermo2      ---------- ---------- -------MA  RKVLVALLVF LVVLSVSAVP
SEQ ID NO: 75      ---------- ---------- ---------- ---------- ----------
SEQ ID NO: 77      ---------- ---------- ---------- ---------- ----------
SEQ ID NO: 83      ---------- ---------- ---------- ---------- ----------
SEQ ID NO: 85      ---------- ---------- ---------- ---------- ----------
SEQ ID NO: 79      ---------- ---------- ----MKPAKL LVFVLVVSIL AGLYAQPAGA
      thermo       SESQCTATCT WRVVYMSAKK LLALLFVLAV LVGVAVIPAR VGIAPVSAGA
      pyro2        ---------- ---------- -----VNIKK LTPLLTLLLP PIVLASPVSA
      CLONE A      ---------- ---------- ---MRRSARV LVLIIAFFLL AGIYYPSTSA
      Consensus    ---------- ---------- ---------- ---------- ----------

51                                                             100
SEQ ID NO: 81      AKYSELEEGG VIMQAFYWDV PGGGIWWDTI RSKIPEWYEA GISAIWIPPA
      pyro         AKYSELEEGG VIMQAFYWDV PAGGIWWDTI RSKIPEWYEA GISAIWIPPA
SEQ ID NO: 73      ---MALEEGG LIMQAFYWDV PGGGIWWDTI AQKIPDWASA GISAIWIPPA
      thermo2      AKAETLENGG VIMQAFYWDV PGGGIWWDTI AQKIPDWASA GISAIWIPPA
SEQ ID NO: 75      ---MALEEGG LIMQAFYWDV PMGGIWWDTI AQKIPDWASA GISAIWIPPA
SEQ ID NO: 77      ---MALEEGG LIMQAFYWDV PMGGIWWDTI AQKIPDWASA GISAIWIPPA
SEQ ID NO: 83      ---MALEEGG LIMQAFYWDV PGGGIWWDTI AQKIPEWASA GISAIWIPPA
SEQ ID NO: 85      ---MALEEGG LIMQAFYWDV PGGGIWWDTI AQKIPEWASA GISAIWIPPA
SEQ ID NO: 79      AKYLELEEGG VIMQAFYWDV PSGGIWWDTI RQKIPEWYDA GISAIWIPPA
      thermo       TSRPSLEEGG VIMQAFYWDV PAGGIWWDTI RSKIPDWASA GISAIWIPPA
      pyro2        AKYLELEEGG VIMQAFYWDV PGGGIWWDHI RSKIPEWYEA GISAIWLPPP
      CLONE A      AKYSELEQGG VIMQAFYWDV PEGGIWWDTI RQKIPEWYDA GISAIWIPPA
      Consensus    ----------GG -IMQAFYWDV P-GGIWWD-I --KIP-W--A GISAIW-PP- 101                                                            150
SEQ ID NO: 81      SKGMSGGYSM GYDPYDFFDL GEYNQKGTIE TRFGSKQELI NMINTAHAYG
      pyro         SKGMGGAYSM GYDPYDFFDL GEYNQKGTVE TRFGSKQELI NMINTAHAYG
SEQ ID NO: 73      SKGMSGGYSM GYDPYDFFDL GEYYQKGSVE TRFGSKEELV NMINTAHAHN
      thermo2      SKGMSGGYSM GYDPYDFFDL GEYYQKGSVE TRFGSKEELV NMINTAHAHN
SEQ ID NO: 75      SKGMSGGYSM GYDPYDYFDL GEYYQKGTVE TRFGSKQELI NMINTAHAYG
SEQ ID NO: 77      SKGMSGGYSM GYDPYDYFDL GEYYQKGTVE TRFGSKQELI NMINTAHAYG
SEQ ID NO: 83      SKGMSGGYSM GYDPYDFFDL GEYYQKGTVE TRFGSKEELV NMINTAHSYG
SEQ ID NO: 85      SKGMSGGYSM GYDPYDFFDL GEYYQKGTVE TRFGSKEELV NMINTAHSYG
SEQ ID NO: 79      SKGMGGAYSM GYDPYDFFDL GEYDQKGTVE TRFGSKQELV NMINTAHAYG
      thermo       SKGMSGAYSM GYDPYDFFDL GEYYQKGTVE TRFGSKQELI NMINTAHSYG
      pyro2        SKGMSGGYSM GYDPYDYFDL GEYYQKGTVE TRFGSKEELV RLIQTAHAYG
      CLONE A      SKGMGGAYSM GYDPYDYFDL GEFYQKGTVE TRFGSKEELV NMISTAHQYG
      Consensus    SKGM-G-YSM GYDPYD-FDL GE--QKG--E TRFGSK-EL- --I-TAH---

151                                                            200
SEQ ID NO: 81      IKVIADIVIN HRAGGDLEWN PFVGDYTWTD FSKVASGKYT ANYLDFHPNE
      pyro         IKVIADIVIN HRAGGDLEWN PFVGDYTWTD FSKVASGKYT ANYLDFHPNE
SEQ ID NO: 73      MKVIADIVIN HRAGGDLEWN PFTNSYTWTD FSKVASGKYT ANYLDFHPNE
      thermo2      MKVIADIVIN HRAGGDLEWN PFTNSYTWTD FSKVASGKYT ANYLDFHPNE
SEQ ID NO: 75      MKVIADIVIN HRAGGDLEWN PFVNDYTWTD FSKVASGKYT ANYLDFHPNE
SEQ ID NO: 77      MKVIADIVIN HRAGGDLEWN PFVNDYTWTD FSKVASGKYT ANYLDFHPNE
SEQ ID NO: 83      IKVIADIVIN HRAGGDLEWN PFVNDYTWTD FSKVASGKYT ANYLDFHPNE
SEQ ID NO: 85      IKVIADIVIN HRAGGGLEWN PFVNDYTWTD FSKVASGKYT ANYLDFHPNE
SEQ ID NO: 79      IKVIADIVIN HRAGGDLEWN PFVNDYTWTD FSKVASGKYT ANYLDFHPNE
      thermo       IKVIADIVIN HRAGGDLEWN PFTNSYTWTD FSKVASGKYT ANYLDFHPNE
      pyro2        IKVIADVVIN HRAGGDLEWN PFVGDYTWTD FSKVASGKYT ANYLDFHPNE
      CLONE A      IKVIADIVIN HRAGGDLEWN PYVGDYTWTD FSKVASGKYK AHYMDFHPNN
      Consensus    -KVIAD-VIN HRAGG-LEWN P----YTWTD FSKVASGKY- A-Y-DFHPN-
```

FIGURE 14B

```
              201                                                           250
SEQ ID NO: 81  VKCCD EGTFG  GFPDIAHEKS  WDQHWLWASD  ESYAAYLRSI  GVDAWRFDY V
       pyro   VKCCD EGTFG  GFPDIAHEKE  WDQHWLWASD  ESYAAYLRSI  GVDAWRFDY V
SEQ ID NO: 73  LHAGD SGTFG  GYPDICHDKS  WDQHWLWASN  ESYAAYLRSI  GIDAWRFDY V
       thermo2 LHAGD SGTFG  GYPDICHDKS  WDQHWLWASN  ESYAAYLRSI  GIDAWRFDY V
SEQ ID NO: 75  LHAGD SGTFG  GYPDICHDKS  WDQYWLWASQ  ESYAAYLRSI  GIDAWRFDY V
SEQ ID NO: 77  LHAGD SGTFG  GYPDICHDKS  WDQYWLWASQ  ESYAAYLRSI  GIDAWRFDY V
SEQ ID NO: 83  LHCCD EGTFG  GYPDICHDKS  WDQYWLWASS  ESYAAYLRSI  GVDAWRFDY V
SEQ ID NO: 85  LHCCD EGTFG  GYPDICHDKS  WDQYWLWASS  ESYAAYLRSI  GVDAWCFDY V
SEQ ID NO: 79  VKCCD EGTFG  GFPDIAHEKS  WDQYWLWASN  ESYAAYLRSI  GVDAWRFDY V
       thermo  VKCCD EGTFG  GFPDIAHEKS  WDQYWLWASQ  KSYAAYLRSI  GIDAWRFDY V
       pyro2   LHCCD EGTFG  GFPDICHHKE  WDQYWLWKSN  ESYAAYLRSI  GFDGWRFDY V
       CLONE A YSTSD EGTFG  GFPDIDHLVP  FNQYWLWASN  ESYAAYLRSI  GIDAWRFDY V
       Consensus ----D -GTFG  G-PDI-H--- --Q-WLW-S- -SYAAYLRSI  G-D-W-FDY V 251                                                           300
SEQ ID NO: 81  KGYGA WVVKD  WLNWWGGWAV  GEYWDTN VDA  LLNWAYSSGA  KVFDFPLYY K
       pyro   KGYGA WVVKD  WLNWWGGWAV  GEYWDTN VDA  LLNWAYSSGA  KVFDFPLYY K
SEQ ID NO: 73  KGYAP WVVKN  WLNRWGGWAV  GEYWDTN VDA  LLSWAYDSGA  KVFDFPLYY K
       thermo2 KGYAP WVVKN  WLNRWGGWAV  GEYWDTN VDA  LLSWAYDSGA  KVFDFPLYY K
SEQ ID NO: 75  KGYAP WVVRD  WLNWWGGWAV  GEYWDTN VDA  VLNWAYSSGA  KVFDFALYY K
SEQ ID NO: 77  KGYAP WVVKD  WLNWWGGWAV  GEYWDTN VDA  VLNWAYSSGA  KVFDFALYY K
SEQ ID NO: 83  KGYGA WVVND  WLSWWGGWAV  GEYWDTN VDA  LLNWAYSSGA  KVFDPPLYY K
SEQ ID NO: 85  KGYGA WVVND  WLSWWGGWAV  GEYWDTN VDA  LLNWAYNSGA  KVFDPPLYY K
SEQ ID NO: 79  KGYGA WVVKD  WLDWWGGWAV  GEYWDTN VDA  LLNWAYSSDA  KVFDPPLYY K
       thermo  KGYGA WVVKD  WLKWW.ALAV  GEYWDTN VDA  LLNWAYSSGA  KVFDPPLYY K
       pyro2   KGYGA WVVRD  WLNWWGGWAV  GEYWDTN VDA  LLSWAYESGA  KVFDPPLYY K
       CLONE A KGYGA WVVKD  WLSQWGGWAV  GEYWDTN VDA  LLNWAYSSGA  KVFDPPLYY K
       Consensus KGY-- WVV-- WL--W- --AV  GEYWDTN VDA  -L-HAY-S-A  KVFDF-LYY K 301                                                           350
SEQ ID NO: 81  MDEAF DNKNI  PALVSA LQNG  QTVVSRD PFK  AVTFVANH DT  DIIWNKYLA Y
       pyro   MDEAF DNTNI  PALVDA LQNG  GTVVSRD PFK  AVTFVANH DT  DIIWNKYPA Y
SEQ ID NO: 73  MDEAF DNNNI  PALVDA LKNG  GTVVSRD PFK  AVTFVANH DT  NIIWNKYPA Y
       thermo2 MDEAF DNNNI  PALVDA LKNG  GTVVSRD PFK  AVTFVANH DT  NIIWNKYPA Y
SEQ ID NO: 75  MDEAF DNNNI  PALVDA LRYG  QTVVSRD PFK  AVTFVANH DT  DIIWNKYPA Y
SEQ ID NO: 77  MDEAF DNNNI  PALVDA LRYG  QTVVSRD PFK  AVTFVANH DT  DIIWNKYPA Y
SEQ ID NO: 83  MDEAF DNTNI  PALVDA LRYG  QTVVSRD PFK  AVTFVANH DT  DIIWNKYPA Y
SEQ ID NO: 85  MDEAF DNTNI  PALVYA LKNG  QTVVSRD PFK  AVTFVANH DT  DIIWNKYPA Y
SEQ ID NO: 79  MDAAF DNKNI  PALVEA LKNG  GTVVSRD PFK  AVTFVANH DT  DIIWNKYPA Y
       thermo  MDEAF DNKNI  PALVSA LQNG  QTVVSRD PFK  AVTFVANH DT  DIIWNKYPA Y
       pyro2   MDEAF DNNNI  PALVYA LQNG  QTVVSRD PFK  AVTFVANH DT  DIIWNKYPA Y
       CLONE A MDEAF DNKNI  PALVYA IQNG  GTVVSRD PEK  AVTFVANH DT  NIIWNKYPA Y
       Consensus MD-AF DN-NI  PALV-A ---G  -TVVSRD PFK  AVTFVANH DT  -IIWNKY-A Y 351                                                           400
SEQ ID NO: 81  AFILT YEGQP  VIFYRD YEEW  LNKDRLN NLI  WIHDHLAGGS  TSIVYYDSD E
       pyro   AFILT YEGQP  VIFYRD YEEW  LNKDKLN NLI  WIHDHLAGGS  TSIVYYDSD E
SEQ ID NO: 73  AFILT YEGQP  AIFYRD YEEW  LNKDRLR NLI  WIHDHLAGGS  TDIIYYDSD E
       thermo2 AFILT YEGQP  AIFYRD YEEW  LNKDRLR NLI  WIHDHLAGGS  TDIIYYDSD E
SEQ ID NO: 75  AFILT YEGQP  TIFYRD YEEW  LNKDKLK NLI  WIHDNLAGGS  TDIVYYDND E
SEQ ID NO: 77  AFILT YEGQP  TIFYRD YEEW  LNKDKLK NLI  WIHDNLAGGS  TDIVYYDND E
SEQ ID NO: 83  AFILT YEGQP  VIFYRD YEEW  LNKDKLN NLI  WIHDHLAGGS  TDIVYYDSD E
SEQ ID NO: 85  AFILT YEGQP  VIFYRD YEEW  LNKDKLN NLI  WIHDHLAGGS  TDIVYYDSD E
SEQ ID NO: 79  AFILT YEGQP  TIFYRD YEEW  LNKDRLK NLI  WIHDHLAGGS  TDIVYYDND E
       thermo  AFILT YEGQP  VIFYRD YEEW  LNKDRLK NLI  WIHNNLAGGS  TSIVYYDND E
       pyro2   AFILT YEGQP  VIFYRD FEEW  LNKDKLI NLI  WIHDHLAGGS  TTIVYYDND E
       CLONE A AFILT YEGQP  VIFYRD YEEW  LNKDKLN NLI  WIHEHLAGGS  TKILYYDDD E
       Consensus AFILT YEGQP  -IFYRD -EEW  LNKD-L-NLI  WIH--LAGGS  T-I-YYD-D E
```

FIGURE 14B
(cont.)

```
                401                                                                              450
SEQ ID NO: 81   MIFVRNGYGS  KPGLITYINL  GSSKVGRWVY  V.PKFAGACI  HEYTGNLGGW
        pyro    LIFVRNGDSK  RPGLITYINL  GSSKVGRWVY  V.PKFAGACI  HEYTGNLGGW
SEQ ID NO: 73   LIFVRNGYGD  KPGLITYINL  GSSKAGRWVY  V.PKFAGSCI  HEYTGNLGGW
      thermo2   LIFVRNGYGD  KPGLITYINL  GSSKAGRWVY  V.PKFAGSCI  HEYTGNLGGW
SEQ ID NO: 75   LIFVRNGYGS  KPGLITYINL  GSSKAGRWVY  V.PKFAGSCI  HEYTGNLGGW
SEQ ID NO: 77   LIFVRNGYGS  KPGLITYINL  ASSKAGRWVY  V.PKFAGSCI  HEYTGNLGGW
SEQ ID NO: 83   LIFVRNGYGT  KPGLITYINL  GSSKVGRWVY  V.PKFAGSCI  HEYTGNLGGW
SEQ ID NO: 85   LIFVRNGYGT  KPGLITYINL  GSSKAGRWVY  V.PKFAGSCI  HEYTGSLGGW
SEQ ID NO: 79   LIFVRNGYGD  KPGLITYINL  GSSKAGRWVY  V.PKFAGACI  HEYTGNLGGW
       thermo   LIFVRNGYGN  KPGLITYINL  GSSKVGRWVY  V.PKFAGSCI  HEYTGNLGGW
        pyro2   LIFVRNGDSR  RPGLITYINL  SPNWVGRWVY  V.PKFAGACI  HEYTGNLGGW
      CLONE A   LIFMREGYGD  RPGLITYINL  GSDWABRWVN  VGSKFAGYTI  HEYTGNLGGW
    Consensus   -IF-R-G---  -PGLITYINL  ------RWV-  V--KFAG--I  HEYTG-LGGW 451                                  487
SEQ ID NO: 81   VDKYV YSSGW  VYFEAP AYDP  ANGQYGY SVW  SYCGVG*
        pyro    VDKYV ESSGW  VYLEAP AYDP  ASGQYGY TVW  SYCGVG*
SEQ ID NO: 73   IDKWV DSSGR  VYLEAP AHDP  ANGQYGY SVW  SYCGVG*
      thermo2   IDKWV DSSGR  VYLEAP AHDP  ANGQYGY SVW  SYCGVG*
SEQ ID NO: 75   VDKWV DSSGW  VYLEAP AHDP  ANGQYGY SVW  SYCGVG*
SEQ ID NO: 77   VDKWV DSSGW  VYLEAP AHDP  ANGQYGY SVW  SYCGVG*
SEQ ID NO: 83   IDKYV SSSGW  VYLEAP AHDP  ANGYYGY SVW  SYCGVG*
SEQ ID NO: 85   IDKYV SSSGW  VYLEAP AHDP  ANGQYGY SVW  SYCGVG*
SEQ ID NO: 79   VDKWV DSSGW  VYLEAP AHDP  ANGYYGY SVW  SYCGVG*
       thermo   VDKYV GSNGW  VYLEAP AHDP  AKGQYGY SVW  SYCGVG*
        pyro2   VDKRV DSSGW  VYLEAP PHDP  ANGYYGY SVW  SYCGVG*
      CLONE A   VDRYV QYDGW  VKLTAP PHDP  ANGYYGY SVW  SYAGVG*
    Consensus   -D--V ---G-  V---AP --DP  A-G-YGY -VW  SY-GVG*
```

FIGURE 14B
(cont.)

```
              1                                                           50
SEQ ID NO: 83  ---------- ---------- ---------- ---------- ----------
SEQ ID NO: 85  ---------- ---------- ---------- ---------- ----------
SEQ ID NO: 75  ---------- ---------- ---------- ---------- ----------
SEQ ID NO: 77  ---------- ---------- ---------- ---------- ----------
SEQ ID NO: 73  ---------- ---------- ---------- ---------- ----------
SEQ ID NO: 79  ---ATGAAGC CTGCGAAACT CCTCGTCTTT GTGCTCGTAG TCTCTATCCT
SEQ ID NO: 81  ---ATGAAGA AGTTTGTCGC CCTGTTCATA ACCATGTTTT TCGTAGTGAG
     CLONE A   ATGAGGAGAT CCGCAAGGGT TTTGGTTCTG ATTATAGCGT TTTTCCTCCT
   Consensus   ---------- ---------- ---------- ---------- ----------

51                                                         100
SEQ ID NO: 83  ---------- ---------- ---------- ---------- ATGGCTCTGG
SEQ ID NO: 85  ---------- ---------- ---------- ---------- ATGGCTCTGG
SEQ ID NO: 75  ---------- ---------- ---------- ---------- ATGGCTCTGG
SEQ ID NO: 77  ---------- ---------- ---------- ---------- ATGGCTCTGG
SEQ ID NO: 73  ---------- ---------- ---------- ---------- ATGGCTCTGG
SEQ ID NO: 79  CGCGGGCTC TACGCCCAGC CCGCGGGGGC GGCCAAGTAC CTGGAGCTCG
SEQ ID NO: 81  CATGGCAGTC GTTGCACAGC CAGCTAGCGC CGCAAAGTAT TCCGAGCTCG
     CLONE A   GGCGGGGATT TACTACCCCT CCACGAGTGC CGCGAAGTAC TCCGAGCTGG
   Consensus   ---------- ---------- ---------- ---------- ----------

101                                                        150
SEQ ID NO: 83  AAGAGGGCGG GCTCATAATG CAGGCCTTCT ACTGGGATGT TCCTGGAGGA
SEQ ID NO: 85  AAGAGGGCGG GCTTATAATG CAGGCATTCT ATTGGGACGT CCCAGGTGGA
SEQ ID NO: 75  AAGAGGGCGG GCTTATAATG CAGGCATTCT ACTGGGACGT CCCCATGGGA
SEQ ID NO: 77  AAGAGGGCGG GCTCATAATG CAGGCCTTCT ACTGGGACGT CCCCATGGGA
SEQ ID NO: 73  TAGAGGGCGG GCTTATAATG CAGGCCTTCT ACTGGGACGT CCCAGGTGGA
SEQ ID NO: 79  AAGAGGGCGG CGTCATAATG CAGGCGTTCT ACTGGGACGT GCCTTCAGGA
SEQ ID NO: 81  AAGAAGGCGG CGTTATAATG CAGGCCTTCT ACTGGGACGT CCCAGGTGGA
     CLONE A   AGCAGGGCGG AGTCATAATG CAGGCCTTCT ACTGGGACGT TCCGGAGGGA
   Consensus   -----GGCGG --T-ATAATG CAGGC-TTCT A-TGGGA-GT -CC----GGA 151                                                        200
SEQ ID NO: 83  GGAATCTGGT GGGACACAAT AGCTCAAAAG ATACCCGAAT GGGCAAGTGC
SEQ ID NO: 85  GGAATCTGGT GGGACACCAT AGCCCAGAAG ATACCCGAAT GGGCAAGTGC
SEQ ID NO: 75  GGAATCTGGT GGGACACGAT AGCCCAGAAG ATACCCGACT GGGCAAGCGC
SEQ ID NO: 77  GGAATCTGGT GGGACACGAT AGCCCAGAAG ATACCCGACT GGGCAAGCGC
SEQ ID NO: 73  GGAATCTGGT GGGACACCAT AGCCCAGAAG ATACCCGACT GGGCGAGCGC
SEQ ID NO: 79  GGAATATGGT GGGACACAAT ACGGCAGAAG ATACCGGAGT GGTACGATGC
SEQ ID NO: 81  GGAATCTGGT GGGACACCAT CAGGAGCAAG ATACCGGAGT GGTACGAGGC
     CLONE A   GGAATCTGGT GGGACACAAT ACGGCAGAAG ATCCCTGAAT GGTACGATGC
   Consensus   GGAAT-TGGT GGGACAC-AT -------AAG AT-CC-GA-T GG------GC 201                                                        250
SEQ ID NO: 83  AGGAATCTCA GCGATATGGA TTCCACCAGC GAGTAAGGGC ATGAGCGGTG
SEQ ID NO: 85  AGGAATCTCA GCGATATGGA TTCCACCAGC GAGTAAGGGA ATGAGCGGTG
SEQ ID NO: 75  CGGGATTTCG GCGATATGGA TTCCCCCCGC GAGCAAGGGT ATGAGCGGCG
SEQ ID NO: 77  CGGGATTTCG GCGATATGGA TCCCTCCCGC GAGCAAGGGT ATGAGCGGCG
SEQ ID NO: 73  CGGGATTTCG GCAATATGGA TTCCTCCCGC GAGTAAGGGC ATGAGCGGCG
SEQ ID NO: 79  CGGAATCTCC GCAATATGGA TTCCCCCGGC GAGCAAGGGC ATGGGCGGCG
SEQ ID NO: 81  GGGAATATCC GCCATTTGGA TTCCGCCAGC CAGCAAGGGG ATGAGCGGCG
     CLONE A   AGGCATATCC GCCATCTGGA TACCCCCGGC GAGCAAGGGC ATGGGCGGGG
   Consensus   -GG-AT-TC- GC-AT-TGGA T-CC-CC-GC -AG-AAGGG- ATG-GCGG-G
```

FIGURE 14C

|              | 251        |            |            |            | 300        |
|--------------|------------|------------|------------|------------|------------|
| SEQ ID NO: 83 | GTTATTC CAT | GGGCTACG AT | CCCTACGAT T | TCTTTGACCT | CGGCGAGTAC |
| SEQ ID NO: 85 | GTTATTC CAT | GGGCTACG AT | CCCTACGAT T | TCTTTGACCT | CGGCGAGTAC |
| SEQ ID NO: 75 | GCTATTC GAT | GGGCTACG AC | CCCTACGAT T | ATTTTGACCT | CGGTGAGTAC |
| SEQ ID NO: 77 | GCTATTC GAT | GGGCTACG AC | CCCTACGAT T | ATTTTGACCT | CGGTGAGTAC |
| SEQ ID NO: 73 | GCTATTC GAT | GGGCTAC GAC | CCCTACGAT T | TCTTCGACCT | CGGTGAGTAC |
| SEQ ID NO: 79 | CCTATTC GAT | GGGCTACG AC | CCCTACGAC T | TCTTTGACCT | CGGTGAGTAC |
| SEQ ID NO: 81 | GTTACTC GAT | GGGCTACG AT | CCCTACGAT T | TCTTTGACCT | CGGCGAGTAC |
| CLONE A      | CCTACTC GAT | GGGCTACG AC | CCCTACGAT T | ACTTCGATCT | GGGCGAGTTT |
| Consensus    | --TA-TC -AT | GGGCTACGA- | CCCTACGA- T | --TT-GA-CT | -GG-GAGT-- |

|              | 301        |            |            |            | 350        |
|--------------|------------|------------|------------|------------|------------|
| SEQ ID NO: 83 | TATCAGA AGG | GGACAGTT GA | GACGCGCTT C | GGCTCAAAGG | AAGAACTGGT |
| SEQ ID NO: 85 | TATCAGA AGG | GGACAGTT GA | GACGCGCTT C | GGCTCAAAGG | AAGAACTGGT |
| SEQ ID NO: 75 | TACCAGA AGG | GAACGGTG GA | AACAAGATT C | GGCTCAAAGC | AGGAGCTCAT |
| SEQ ID NO: 77 | TACCAGA AGG | GAACGGTG GA | AACGAGGTT C | GGCTCAAAGC | AGGAGCTCAT |
| SEQ ID NO: 73 | TACCAGA AGG | GAAGCGTT GA | GACCCGCTT C | GGATCAAAAG | AGGAGCTTGT |
| SEQ ID NO: 79 | GACCAGA AGG | GAACGGTA GA | GACGCGCTT T | GGCTCCAAGC | AGGAGCTCGT |
| SEQ ID NO: 81 | AACCAGA AGG | GAACCATC GA | AACGCGCTT T | GGCTCTAAAC | AGGAGCTCAT |
| CLONE A      | TACCAGA AGG | GAACCGTT GA | GACCCGCTT C | GGCTCCAAGG | AAGAGCTCGT |
| Consensus    | -A-CAGA AGG | G-A---T- GA | -AC--G-TT - | GG-TC-AA-- | A-GA-CT--T |

|              | 351        |            |            |            | 400        |
|--------------|------------|------------|------------|------------|------------|
| SEQ ID NO: 83 | GAACATG ATA | AACACCGC AC | ACTCCTACG G | CATAAAGGTG | ATAGCAGACA |
| SEQ ID NO: 85 | GAACATG ATA | AACACCGC AC | ACTCCTACG G | CATAAAGGTG | ATAGCGGACA |
| SEQ ID NO: 75 | AAACATG ATA | AACACCGC CC | ACGCCTATG G | CATGAAGGTA | ATAGCCGATA |
| SEQ ID NO: 77 | AAACATG ATA | AACACCGC CC | ACGCCTATG G | CATGAAGGTA | ATAGCCGATA |
| SEQ ID NO: 73 | GAACATG ATA | AACACCGC CC | ATGCTCACA A | CATGAAGGTC | ATAGCGGACA |
| SEQ ID NO: 79 | GAACATG ATA | AACACCGC CC | ACGCCTACG G | CATCAAGGTC | ATCGCAGACA |
| SEQ ID NO: 81 | CAATATG ATA | AACACGGC CC | ATGCCTACG G | CATAAAGGTC | ATAGCGGACA |
| CLONE A      | CAACATG ATC | TCCACGGC CC | ACCAGTACG G | CATCAAGGTT | ATAGCGGACA |
| Consensus    | -AA-ATGAT- | --CAC-GC -C | A-----A--- | CAT-AAGGT- | AT-GC-GA-A |

|              | 401        |            |            |            | 450        |
|--------------|------------|------------|------------|------------|------------|
| SEQ ID NO: 83 | TAGTCAT AAA | CCACCGCG CC | GGTGGAGAC C | TTGAGTGGAA | CCCCTTCGTG |
| SEQ ID NO: 85 | TAGTCAT AAA | CCACCGCG CC | GGTGGAGGC C | TCGAGTGGAA | CCCCTTCGTG |
| SEQ ID NO: 75 | TAGTCAT CAA | CCACCGCG CC | GGCGGCGAT C | TGGAGTGGAA | CCCCTTCGTG |
| SEQ ID NO: 77 | TAGTCAT CAA | CCACCGCG CC | GGCGGTGAC C | TGGAGTGGAA | CCCCTTCGTG |
| SEQ ID NO: 73 | TAGTCAT CAA | CCACCGCG CC | GGCGGCGAC C | TGGAGTGGAA | TCCTTTCACC |
| SEQ ID NO: 79 | TAGTAAT CAA | CCACCGCG CC | GGAGGAGAC C | TTGAGTGGAA | CCCCTTCGTC |
| SEQ ID NO: 81 | TCGTCAT AAA | CCACCGCG CA | GGCGGAGAC C | TCGAGTGGAA | CCCGTTCGTT |
| CLONE A      | TAGTGAT AAA | CCACCGCG CA | GGTGGAGAC C | TCGAATGGAA | CCCATACGTC |
| Consensus    | T-GT-AT -AA | CCACCGCG C- | GG-GG-G-- C | T-GA-TGGAA | -CC-T-C--- |

|              | 451        |            |            |            | 500        |
|--------------|------------|------------|------------|------------|------------|
| SEQ ID NO: 83 | AACGACT ATA | CCTGGACA GA | CTTCTCAAA A | GTCGCCTCCG | GTAAATATAC |
| SEQ ID NO: 85 | AACGACT ATA | CCTGGACA GA | CTTCTCAAA A | GTCGCCTCCG | GTAAATATAC |
| SEQ ID NO: 75 | AACGACT ATA | CCTGGACC GA | CTTCTCGAA G | GTCGCGTCGG | GTAAATACAC |
| SEQ ID NO: 77 | AACGACT ATA | CCTGGACC GA | CTTCTCAAA G | GTCGCGTCGG | GTAAATACAC |
| SEQ ID NO: 73 | AACAGCT ACA | CCTGGACC GA | TTTCTCGAA G | GTCGCGTCGG | GCAAGTACAC |
| SEQ ID NO: 79 | AATGACT ACA | CCTGGACG GA | CTTCTCGAA G | GTCGCTTCCG | GCAAGTACAC |
| SEQ ID NO: 81 | GGGGACT ACA | CCTGGACG GA | CTTCTCAAA G | GTGGCCTCGG | GCAAATATAC |
| CLONE A      | GGCGACT ATA | CCTGGACG GA | CTTTTCTAA G | GTCGCCTCCG | GGAAATACAA |
| Consensus    | -----CT A-A | CCTGGAC- GA | -TT-TC-AA- | GT-GC-TC-G | G-AA-TA-A- |

FIGURE 14C
(cont.)

```
                        501                                                           550
SEQ ID NO: 83    GGCCAACTAC  CTTGACTTCC  ACCCAAACGA  GCTTCACTGT  TGTGATGAAG
SEQ ID NO: 85    AGCCAACTAC  CTTGACTTCC  ACCCAAACGA  GCTTCACTGT  TGTGATGAAG
SEQ ID NO: 75    GGCCAACTAC  CTCGACTTCC  ACCCGAACGA  GCTCCACGCG  GGCGATTCCG
SEQ ID NO: 77    GGCCAACTAC  CTCGACTTCC  ACCCGAACGA  GCTCCATGCG  GGCGATTCCG
SEQ ID NO: 73    GGCCAACTAC  CTCGACTTCC  ACCCGAACGA  GCTTCACGCG  GGCGATTCCG
SEQ ID NO: 79    GGCCAACTAC  CTCGACTTCC  ACCCCAACGA  GGTCAAGTGC  TGCGACGAGG
SEQ ID NO: 81    TGCCAACTAC  CTCGACTTCC  ACCCCAACGA  GGTCAAGTGC  TGTGACGAGG
    CLONE A      GGCCCACTAC  ATGGACTTCC  ATCCAAACAA  CTACAGCACC  TCAGACGAGG
Consensus        -GCC-ACTAC  -T-GACTTCC  A-CC-AAC- A  ----------  ---GA----G 551                                                           600
SEQ ID NO: 83    GTACCTTTGG  AGGATACCCT  GATATATGTC  ACGACAAAAG  CTGGGACCAG
SEQ ID NO: 85    GTACCTTTGG  AGGATACCCT  GATATATGTC  ACGACAAAAG  CTGGGACCAG
SEQ ID NO: 75    GAACATTTGG  AGGCTATCCC  GACATATGCC  ACGACAAGAG  CTGGGACCAG
SEQ ID NO: 77    GAACATTTGG  AGGCTATCCC  GACATATGCC  ACGACAAGAG  CTGGGACCAG
SEQ ID NO: 73    GAACATTTGG  AGGCTATCCC  GACATATGCC  ACGACAAGAG  CTGGGACCAG
SEQ ID NO: 79    GCACCTTTGG  AGGGTTCCCG  GACATAGCCC  ACGAGAAGAG  CTGGGACCAG
SEQ ID NO: 81    GCACATTTGG  AGGCTTCCCA  GACATAGCCC  ACGAGAAGAG  CTGGGACCAG
    CLONE A      GAACCTTCGG  TGGCTTCCCA  GACATTGATC  ACCTCGTGCC  CTTCAACCAG
Consensus        G-AC-TT-GG  -GG-T--CC-  GA-AT----C  AC--------  CT---ACCAG 601                                                           650
SEQ ID NO: 83    TACTGGCTCT  GGGCGAGCAG  CGAAAGCTAC  GCTGCCTACC  TCAGGAGCAT
SEQ ID NO: 85    TACTGGCTCT  GGGCGAGCAG  CGAAAGCTAC  GCTGCCTACC  TCAGGAGCAT
SEQ ID NO: 75    TACTGGCTCT  GGGCCAGCCA  GGAGAGCTAC  GCGGCCTATC  TCAGGAGCAT
SEQ ID NO: 77    TACTGGCTCT  GGGCCAGCCA  GGAGAGCTAC  GCGGCATATC  TCAGGAGCAT
SEQ ID NO: 73    CACTGGCTCT  GGGCCAGCAA  CGAAAGCTAC  GCCGCCTACC  TCCGGAGCAT
SEQ ID NO: 79    TACTGGCTCT  GGGCGAGCAA  CGAGAGCTAC  GCCGCCTACC  TCAGGAGCAT
SEQ ID NO: 81    CACTGGCTCT  GGGCGAGCGA  TGAGAGCTAC  GCCGCCTACC  TAAGGAGCAT
    CLONE A      TACTGGCTGT  GGGCGAGCAA  CGAGAGCTAC  GCCGCCTACC  TCAGGAGCAT
Consensus        -ACTGGCT-T  GGGC-AGC--  -GA-AGCTAC  GC-GC-TA-C  T--GGAGCAT 651                                                           700
SEQ ID NO: 83    AGGGGTTGAC  GCCTGGCGTT  TCGACTACGT  CAAGGGCTAC  GGAGCATGGG
SEQ ID NO: 85    AGGGGTTGAC  GCCTGGTGTT  TCGACTACGT  CAAGGGCTAC  GGAGCCTGGG
SEQ ID NO: 75    CGGCATCGAC  GCCTGGCGCT  TCGACTACGT  CAAGGGCTAT  GCTCCCTGGG
SEQ ID NO: 77    CGGCATCGAT  GCCTGGCGCT  TCGACTACGT  CAAGGGCTAT  GCTCCCTGGG
SEQ ID NO: 73    CGGCATCGAC  GCCTGGCGCT  TCGACTACGT  CAAGGGCTAC  GCTCCCTGGG
SEQ ID NO: 79    CGGCGTTGAC  GCATGGCGCT  TCGACTACGT  CAAGGGCTAC  GGAGCGTGGG
SEQ ID NO: 81    CGGCGTTGAT  GCCTGGCGCT  TTGACTACGT  GAAGGGCTAC  GGAGCGTGGG
    CLONE A      AGGGATCGAT  GCGTGGCGCT  TTGACTACGT  TAAGGGCTAC  GGCGCGTGGG
Consensus        -GG--T-GA-  GC-TGG-G-T  T-GACTACGT  -AAGGGCTA-  G---C-TGGG 701                                                           750
SEQ ID NO: 83    TTGTTAACGA  CTGGCTCAGC  TGGTGGGGAG  GCTGGGCCGT  TGGAGAGTAC
SEQ ID NO: 85    TTGTTAACGA  CTGGCTCAGC  TGGTGGGGAG  GCTGGGCCGT  TGGAGAGTAC
SEQ ID NO: 75    TCGTCAGGGA  CTGGCTGAAC  TGGTGGGGAG  GCTGGGCAGT  TGGAGAGTAC
SEQ ID NO: 77    TCGTCAAGGA  CTGGCTGAAC  TGGTGGGGAG  GCTGGGCGGT  TGGAGAGTAC
SEQ ID NO: 73    TCGTTAAGAA  CTGGCTGAAC  CGGTGGGGCG  GCTGGGCGGT  TGGAGAGTAC
SEQ ID NO: 79    TCGTCAAGGA  CTGGCTGGAC  TGGTGGGGAG  GCTGGGCCGT  CGGGGAGTAC
SEQ ID NO: 81    TCGTCAAGGA  CTGGCTCAAC  TGGTGGGGCG  GCTGGGCCGT  TGGCGAGTAC
    CLONE A      TCGTCAAGGA  CTGGCTGAGT  CAGTGGGGCG  GCTGGGCCGT  CGGCGAGTAC
Consensus        T-GT-A---A  CTGGCT----  --GTGGGG-G  GCTGGGC-GT  -GG-GAGTAC
```

FIGURE 14C
(cont.)

```
                   751                                                          800
SEQ ID NO: 83   TGGGACA CGA  ACGTTGATGC  ACTCCTCAA C  TGGGCATACA  GCAGCGGCGC
SEQ ID NO: 85   TGGGACA CTA  ACGTTGATGC  ACTCCTCAA C  TGGGCATACA  ACAGCGGCGC
SEQ ID NO: 75   TGGGACA CCA  ACGTCGACGC  TGTTCTCAA C  TGGGCATACT  CGAGCGGTGC
SEQ ID NO: 77   TGGGACA CCA  ACGTCGACGC  TGTTCTCAA C  TGGGCATACT  CGAGCGGTGC
SEQ ID NO: 73   TGGGACA CCA  ACGTCGATGC  ACTCCTGAG C  TGGGCCTACG  ACAGCGGTGC
SEQ ID NO: 79   TGGGACA CAA  ACGTTGATGC  ACTGCTCAA C  TGGGCCTACT  CGAGCGATGC
SEQ ID NO: 81   TGGGACA CCA  ACGTTGATGC  ACTCCTCAA C  TGGGCCTACT  CGAGCGGCGC
     CLONE A    TGGGACA CCA  ACGTCGATGC  GCTCCTCAA C  TGGGCCTACA  GCAGCGGCGC
   Consensus    TGGGACA C-A  ACGT-GA-GC  --T-CT-A- C  TGGGC-TAC-  --AGCG--GC 801                                                          850
SEQ ID NO: 83   CAAGGTC TTT  GACTTCCC GC  TCTACTACA A  GATGGACGAA  GCCTTCGACA
SEQ ID NO: 85   CAAGGTC TTT  GACTTCCC GC  TCTACTACA A  GATGGACGAA  GCCTTCGACA
SEQ ID NO: 75   CAAGGTC TTT  GACTTCGC CC  TCTACTACA A  GATGGACGAG  GCCTTCGATA
SEQ ID NO: 77   CAAGGTC TTT  GACTTCGC CC  TCTACTACA A  GATGGACGAG  GCCTTCGATA
SEQ ID NO: 73   TAAAGTC TTC  GACTTCCC GC  TCTACTACA A  GATGGACGAG  GCCTTCGATA
SEQ ID NO: 79   AAAAGTC TTC  GACTTCCC GC  TCTACTACA A  GATGGACGCG  GCCTTTGACA
SEQ ID NO: 81   CAAGGTC TTC  GACTTCCC GC  TCTACTACA A  GATGGATGAG  GCCTTTGACA
     CLONE A    CAAGGTC TTC  GACTTCCC GC  TCTACTACA A  GATGGACGAG  GCCTTTGACA
   Consensus    -AA-GTC TT-  GACTTC-C -C  TCTACTACA A  GATGGA-G--  GCCTT-GA-A 851                                                          900
SEQ ID NO: 83   ACACCAA CAT  CCCGGCATTA  GTGGATGCA C  TCAGATACGG  CCAGACAGTG
SEQ ID NO: 85   ATACCAA CAT  CCCCGCTT TG  GTTTACGCC C  TCAAGAATGG  CGGGACAGTG
SEQ ID NO: 75   ACAACAA CAT  TCCCGCCC TG  GTGGACGCC C  TCAGATACGG  CCAGACAGTG
SEQ ID NO: 77   ACAACAA CAT  TCCCGCCC TG  GTGGACGCC C  TCAGATACGG  TCAGACAGTG
SEQ ID NO: 73   ACAACAA CAT  CCCCGCCC TC  GTGGACGCC C  TCAAGAACGG  AGGCACGGTC
SEQ ID NO: 79   ACAAGAA CAT  TCCCGCAC TC  GTCGAGGCC C  TCAAGAACGG  GGGCACAGTC
SEQ ID NO: 81   ACAAAAA CAT  TCCAGCGC TC  GTCTCTGCC C  TTCAGAACGG  CCAGACTGTT
     CLONE A    ACAAGAA CAT  TCCCGCCC TC  GTTTACGCC A  TCCAGAACGG  TGAAACCGTC
   Consensus    A-A--AA CAT  -CC-GC--T-  GT----GC- -  T-----A-GG  ----AC-GT- 901                                                          950
SEQ ID NO: 83   GTCAGCC GCG  ATCCCTTCAA  GGCGGTAACT  TTCGTTGCCA  ACCACGATAC
SEQ ID NO: 85   GTCAGCC GCG  ACCCATTCAA  GGCGGTAACT  TTCGTTGCCA  ACCACGATAC
SEQ ID NO: 75   GTCAGCC GCG  ACCCGTTCAA  GGCTGTGACG  TTTGTAGCCA  ACCACGATAC
SEQ ID NO: 77   GTCAGCC GCG  ACCCGTTCAA  GGCTGTGACG  TTTGTAGCCA  ACCACGATAC
SEQ ID NO: 73   GTCAGCC GCG  ACCCGTTCAA  AGCCGTGACC  TTCGTTGCCA  ACCACGATAC
SEQ ID NO: 79   GTCAGCC GCG  ACCCGTTTAA  GGCCGTAACC  TTCGTTGCAA  ACCACGACAC
SEQ ID NO: 81   GTCTCCC GCG  ACCCGTTCAA  GGCCGTAACC  TTTGTAGCAA  ACCACGACAC
     CLONE A    GTCAGCA GGG  ATCCCTTCAA  GGCCGTTAC C  TTCGTGGCTA  ACCACGATAC
   Consensus    GTC--C- G-G  A-CC-TT- AA  -GC-GT-AC -  TT-GT-GC-A  ACCACGA-AC 951                                                         1000
SEQ ID NO: 83   AGATATA ATC  TGGAACAA GT  ATCCGGCTTA  TGCATTCATC  CTTACCTATG
SEQ ID NO: 85   AGATATA ATC  TGGAACAA GT  ATCCGGCTTA  TGCATTCATC  CTTACCTATG
SEQ ID NO: 75   CGACATA ATC  TGGAACAA GT  ATCCAGCCTA  CGCGTTCATC  CTCACCTACG
SEQ ID NO: 77   CGACATA ATC  TGGAACAA GT  ATCCAGCCTA  CGCGTTCATC  CTCACCTACG
SEQ ID NO: 73   CAACATA ATC  TGGAACAA GT  ATCCGGCCTA  CGCCTTCATC  CTCACCTATG
SEQ ID NO: 79   GGACATA ATT  TGGAACAA GT  ACCCGGCCTA  CGCCTTCATC  CTCACCTACG
SEQ ID NO: 81   CGATATA ATC  TGGAACAA GT  ACCTTGCTTA  TGCTTTCATC  CTCACCTACG
     CLONE A    GAACATA ATC  TGGAACAA GT  ACCCTGCCTA  TGCCTTCATC  CTGACCTACG
   Consensus    --A-ATA AT-  TGGAACAA GT  A-C--GC-TA  -GC-TTCATC  CT-ACCTA-G
```

FIGURE 14C
(cont.)

```
              1001                                                    1050
SEQ ID NO: 83  AGGGACAGCC TGTTATATTC TACCGCGACT ACGAGGAGTG GCTCAACAAG
SEQ ID NO: 85  AGGGACAGCC TGTTATATTC TACCGCGACT ACGAGGAGTG GCTCAACAAG
SEQ ID NO: 75  AGGGCCAGCC GACAATATTC TACCGCGACT ACGAGGAGTG GCTCAACAAG
SEQ ID NO: 77  AGGGCCAGCC GACAATATTC TACCGCGACT ACGAGGAGTG GCTCAACAAG
SEQ ID NO: 73  AGGGACAGCC GGCAATATTC TACCGCGACT ACGAGGAGTG GCTCAACAAG
SEQ ID NO: 79  AGGGCCAGCC GACGATATTC TACCGCGACT ACGAGGAGTG GCTCAACAAG
SEQ ID NO: 81  AAGGCCAGCC CGTCATATTT TACCGCGACT ACGAGGAGTG GCTCAACAAG
     CLONE A   AAGGTCAGCC CGTCATCTTC TACCGCGACT ACGAGGAGTG GCTCAACAAG
    Consensus  A-GG-CAGCC ----AT-TT- TACCGCGACT ACGAGGAGTG GCTCAACAAG 1051                                                    1100
SEQ ID NO: 83  GATAAGCTTA ACAACCTCAT CTGGATACAC GATCACCTTG CTGGAGGGAG
SEQ ID NO: 85  GATAAGCTTA ACAACCTCAT CTGGATACAC GATCACCTTG CTGGAGGGAG
SEQ ID NO: 75  GACAAGCTCA AGAACCTCAT CTGGATACAT GACAACCTCG CCGGAGGGAG
SEQ ID NO: 77  GATAAGCTCA AGAACCTCAT CTGGATACAT GACAACCTCG CCGGAGGGAG
SEQ ID NO: 73  GACAGGCTCA GGAACCTCAT CTGGATACAC GACCACCTCG CGGGAGGAAG
SEQ ID NO: 79  GACAGGCTCA AGAACCTCAT CTGGATACAC GACCACCTCG CCGGTGGAAG
SEQ ID NO: 81  GACAGGTTGA ACAACCTCAT ATGGATACAC GACCACCTCG CAGGTGGAAG
     CLONE A   GACAAACTCA ACAACCTCAT ATGGATTCAC GAGCACCTGG CAGGGGAAG
    Consensus  GA-A---T-A --AACCTCAT -TGGAT-CA- GA--ACCT-G C-GG-GG-AG 1101                                                    1150
SEQ ID NO: 83  TACTGACATT GTTTACTACG ACAGCGACGA GCTTATCTTT GTGAGAAACG
SEQ ID NO: 85  TACTGACATT GTTTACTACG ACAGCGACGA GCTTATCTTT GTGAGAAACG
SEQ ID NO: 75  CACTGACATC GTTTACTACG ACAACGACGA GCTGATATTC GTGAGAAATC
SEQ ID NO: 77  CACTGACATC GTTTACTACG ACAACGACGA GCTGATATTC GTGAGAAATC
SEQ ID NO: 73  CACAGACATC ATCTACTACG ACAGCGACGA GCTTATCTTC GTGAGAAACG
SEQ ID NO: 79  CACCGACATA GTCTACTACG ATAACGATGA ACTCATCTTC GTCAGGAACG
SEQ ID NO: 81  CACGAGCATA GTTTACTACG ACAGCGACGA GATGATTTTC GTGAGGAACG
     CLONE A   CACCAAGATC CTCTACTACG ACGACGATGA GCTCATCTTC ATGAGGGAAG
    Consensus  -AC-----AT- -T-TACTACG A---CGA-GA --T-AT-TT- -T-AG--A-G 1151                                                    1200
SEQ ID NO: 83  GCTATGGCAC CAAACCAGGA CTGATAACCT ATATCAACCT CGGCTCAAGC
SEQ ID NO: 85  GCTATGGCAC CAAACCAGGA CTGATAACCT ATATCAACCT CGGCTCAAGC
SEQ ID NO: 75  GCTACGGAAG CAAGCCGGGA CTGATAACAT ACATCAACCT CGGCTCAAGC
SEQ ID NO: 77  GCTACGGAAG CAAGCCGGGA CTGATAACAT ACATCAACCT CGCCTCAAGC
SEQ ID NO: 73  GCTACGGGGA CAAGCCGGGA CTGATAACCT ACATCAACCT CGGCTCAAGC
SEQ ID NO: 79  GCTACGGGGA CAAGCCGGGG CTTATAACCT ACATCAACCT AGGCTCGAGC
SEQ ID NO: 81  GCTATGGAAG CAAGCCTGGC CTTATAACTT ACATCAACCT CGGCTCGAGC
     CLONE A   GCTACGGCGA CAGGCCCGGG CTTATAACCT ACATCAACCT CGGTAGCGAC
    Consensus  GCTA-GG--- CA--CC-GG- CT-ATAAC-T A-ATCAACCT -G------C 1201                                                    1250
SEQ ID NO: 83  AAAGTTGGAA GGTGGGTCTA CGTT...CCA AAGTTCGCCG GTTCATGCAT
SEQ ID NO: 85  AAAGCTGGAA GGTGGGTCTA CGTT...CCA AAGTTCGCCG GTTCATGCAT
SEQ ID NO: 75  AAAGCCGGAA GGTGGGTTTA CGTT...CCG AAGTTCGCAG GCTCGTGCAT
SEQ ID NO: 77  AAAGCCGGAA GGTGGGTTTA CGTT...CCG AAGTTCGCAG GCTCGTGCAT
SEQ ID NO: 73  AAGGCCGGAA GGTGGGTCTA CGTT...CCG AAGTTCGCAG GCTCGTGCAT
SEQ ID NO: 79  AAGGCCGGA  GGTGGGTCTA CGTT...CCG AAGTTCGCGG GAGCGTGCAT
SEQ ID NO: 81  AAGGTTGGAA GGTGGGTTTA TGTG...CCG AAGTTCGCGG GCGCGTGCAT
     CLONE A   TGGGCGGAGA GATGGGTGAA CGTTGGCTCA AAGTTCGCGG GCTATACAAT
    Consensus  ---G--G--A G-TGGGT--A -GT-----C- AAGTTCGC-G G-------AT
```

FIGURE 14C
(cont.)

```
              1251                                                        1300
SEQ ID NO: 83  CCACGAG TAC  ACCGGCAA CC  TCGGCGGTT G  GATAGACAAG  TACGTCTCCT
SEQ ID NO: 85  CCACGAG TAC  ACCGGCAG CC  TCGGCGGTT G  GATAGACAAG  TACGTCTCCT
SEQ ID NO: 75  ACACGAG TAC  ACCGGCAA CC  TCGGCGGCT G  GGTGGACAAG  TGGGTGGACT
SEQ ID NO: 77  ACACGAG TAC  ACCGGCAA TC  TCGGCGGCT G  GGTGGACAAG  TGGGTGGACT
SEQ ID NO: 73  ACACGAG TAC  ACCGGCAA CC  TCGGCGGCT G  GATTGACAAG  TGGGTTGACT
SEQ ID NO: 79  CCACGAG TAC  ACCGGCAA CC  TCGGCGGCT G  GGTGGACAAG  TGGGTGGACT
SEQ ID NO: 81  CCACGAG TAT  ACTGGTAA CC  TCGGAGGCT G  GGTAGACAAG  TACGTCTACT
CLONE A        CCACGAA TAC  ACCGGAAA CC  TCGGCGGCT G  GGTCGACAGG  TACGTCCAGT
Consensus      -CACGA- TA-  AC-GG-A- -C  TCGG-GG-TG   G-T-GACA-G  T--GT----T 1301                                                        1350
SEQ ID NO: 83  CCAGCGG CTG  GGTCTATC TT  GAGGCCCCA G  CCCACGACCC  GGCGAACGGC
SEQ ID NO: 85  CCAGCGG CTG  GGTCTACC TT  GAGGCCCCG G  CCCACGACCC  GGCCAATGGC
SEQ ID NO: 75  CAAGCGG CTG  GGTTTACC TC  GAGGCTCCT G  CCCACGACCC  GGCCAACGGC
SEQ ID NO: 77  CAAGCGG CTG  GGTCTACC TC  GAGGCTCCT G  CCCACGACCC  GGCCAACGGC
SEQ ID NO: 73  CAAGCGG TCG  GGTCTACC TT  GAGGCCCCC G  CCCACGACCC  GGCCAACGGC
SEQ ID NO: 79  CAAGCGG GTG  GGTGTACC TC  GAGGCCCCT G  CCCACGACCC  GGCCAACGGC
SEQ ID NO: 81  CAAGCGG CTG  GGTCTATT TC  GAAGCTCCA G  CTTACGACCC  TGCCAACGGG
CLONE A        ACGACGG CTG  GGTCAAGC TT  ACCGCTCCG C  CACACGATCC  GGCAAACGGC
Consensus      ----CGG --G  GGT--A--T-  ---GC-CC- -  C--ACGA-CC  -GC-AA-GG- 1351                                         1393
SEQ ID NO: 83  TACTACG GCT  ACTCCGTA TG  GAGCTACTG C  GGGGTTGGGT  GA-
SEQ ID NO: 85  CAGTATG GCT  ACTCCGTC TG  GAGCTATTG C  GGGGTTGGGT  GA-
SEQ ID NO: 75  CAGTACG GCT  ACTCCGTT TG  GAGCTATTG C  GGTGTTGGGT  GA-
SEQ ID NO: 77  CAGTACG GCT  ACTCCGTC TG  GAGCTACTG C  GGTGTTGGGT  GA-
SEQ ID NO: 73  CAGTACG GCT  ACTCCGTA TG  GAGCTACTG C  GGTGTTGGGT  GA-
SEQ ID NO: 79  TATTACG GCT  ACTCCGTC TG  GAGCTACTG C  GGGGTGGGCT  GA-
SEQ ID NO: 81  CAGTATG GCT  ACTCCGTG TG  GAGCTATTG C  GGTGTTGGGT  GA-
CLONE A        TATTACG GCT  ACTCGGTC TG  GAGCTACGC C  GGAGTTGGAT  GA-
Consensus      -A-TA-G GCT  ACTC-GT- TG  GAGCTA--- C  GG-GT-GG-T  GA-
```

SEQ ID NO.: 1
atggcaaagtattccgagctcgaagagggcgggctcataatgcaggccttctactgggacgtccccatgggaggaatctggtgggacacgat
agcccagaagatacccgactgggcaagcgccgggatttcggcgatatggattccccggcgagcaagggcatgggcggcgcctattcgatg
ggctacgacccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctacggagcgtgggtcgtcaaggactggctggactg
gtggggaggctgggccgtcggggagtactgggacacaaacgttgatgcactgctcaactgggcctactcgagcgatgcaaaagtcttcgactt
cccgctctactacaagatggacgcggcctttgacaacaagaacattcccgcactcgtcgaggccctcaagaacggggcacagtcgtcagcc
gcgacccgtttaaggccgtaaccttcgttgcaaaccacgacaccgatataatctggaacaagtatccagcctacgcgttcatcctcacctacgag
ggccagccgacaatattctaccgcgactacgaggagtggctcaacaaggataagctcaagaacctcatctggatacatgacaacctcgccgg
aggaagcactgacatcgtttactacgacaacgacgagctgatattcgtgagaaacggctacggaagcaagccgggactgataacatacatcaa
cctcgcctcaagcaaagccggaaggtggtttacgttccgaagttcgcaggctcgtgcatacacgagtacaccggcaatctcggcggctgggt
ggacaagtgggtggactcaagcggctgggtctacctcgaggctcctgcccacgacccggccaacggccagtacggctactccgtctggagc
tactgcggtgttgggtga SEQ ID NO.: 2
Met Ala Lys Tyr Ser Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Trp Val
Val Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Ala
Ala Phe Asp Asn Lys Asn Ile Pro Ala Leu Val Glu Ala Leu Lys Asn Gly Gly Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ser Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Gln Tyr Gly Tyr Ser Val Trp Ser Tyr Cys Gly Val Gly SEQ ID NO.: 3
atggccaagtacctggagctcgaagagggcgggctcataatgcaggccttctactgggacgtccccatgggaggaatctggtgggacacgat
agcccagaagatacccgactgggcaagcgccgggatttcggcgatatggattccccggcgagcaagggcatgggcggcgcctattcgatg
ggctacgacccctacgacttctttgacctcggtgagtacgaccagaagggaacggtagagacgcgctttggctccaagcaggagctcgtgaa
catgataaacaccgcccacgcctacggcatcaaggtcatcgcagacatagtaatcaaccaccgcgccggaggagacccttgagtggaacccct
tcgtcaatgactacacctggacggacttctcgaaggtcgcttccggcaagtacacggccaattacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctatgctccctgggtcgtcaaggactggctgaactggt
ggggaggctgggccgttggagagtactgggacaccaacgtcgacgctgttctcaactgggcatactcgagcggtgccaaggtctttgacttcg
ccctctactacaagatggatgaggcctttgacaacaaaaacattccagcgctcgtctctgcccttcagaacggccagactgttgtctcccgcgac
ccgttcaaggccgtaaccttgtagcaaaccacgacaccgatataatctggaacaagtatccagcctacgcgttcatcctcacctacgagggcc

FIGURE 16B agccgacaatattctaccgcgactacgaggagtggctcaacaaggataagctcaagaacctcatctggatacatgacaacctcgccggagga
agcactgacatcgtttactacgacaacgacgagctgatattcgtgagaaacggctacggaagcaagccgggactgataacatacatcaacctc
gcctcaagcgaagccggaaggtgggtctacgttccgaagttcgcgggagcgtgcatccacgagtacaccggcaacctcggcggctgggtgg
acaagtgggtggactcaagcgggtgggtgtacctcgaggcccctgcccacgacccggccaacggctattacggctactccgtctggagctatt
gcggtgttgggtga SEQ ID NO.: 4
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Glu Ala Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Gly Val Gly SEQ ID NO.: 5
atggccaagtactccgagctggaagagggcggcgttataatgcaggccttctactgggacgtcccaggtggaggaatctggtgggacaccat
caggagcaagataccggagtggtacgaggcgggaatatccgccatttggattccccggcaagcaagggcatgggcggcgcctattcgatg
ggctacgaccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctatgctccctgggtcgtcaaggactggctgaactggt
gggaggctgggoggttgragagttactgggacaccaacgtcgacgctgttctcaactgggcatactcgagcggtgccaaggtctttgacttcg
ccctctactacaagatggatgaggcttgacaacaaaaaacattccageactcgtctctgccettcagaacggccagaotgttgtctcccgggac
ccgttcaaggccgtaaccttgtagcaaaccacgacaccgatataatctggaacaagtaccttgcttatgctttcatcctcacctacgaaggccag
cccgtcatattctaccgcgaccacgaggagtggctcaacaaggacaggttgaacaacctcatatggatacacgaccacctcgcaggtggaag
caccgacatagtctactacgataacgatgaactcatcttcgtcaggaacggctacggggacaagccggggcttataacctacatcaacctaggc
tcgagcaaggccggaaggtgggtttatgtgccgaagttcgcgggcgcgtgcatccacgagtatactggtaacctcggaggctgggtagacaa
gtacgtctactcaagcggctgggtctatctcgaagctccagcttacgaccctgccaacgggcagtatggctactccgtgtggagctactgcggg
gtgggctga SEQ ID NO.: 6
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly

FIGURE 16C

Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Leu Ala
Tyr Ala Phe Ile Leu Thr Tyr Glu Gly Gln Pro Val Ile Phe Tyr Arg Asp His Glu Glu Trp Leu Asn
Lys Asp Arg Leu Asn Asn Leu Ile Trp Ile His Asp His Leu Ala Gly Gly Ser Thr Asp Ile Val Tyr
Tyr Asp Asn Asp Glu Leu Ile Phe Val Arg Asn Gly Tyr Gly Asp Lys Pro Gly Leu Ile Thr Tyr Ile
Asn Leu Gly Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly

SEQ ID NO.: 9
atggccaagtactccgagctggaagagggcgggctcataatgcaggccttctactgggacgtccccatgggaggaatctggtgggacacgat
agcccagaagatacccgactgggcaagcgccgggatttcggcgatatggattccccggcgagcaagggcatgggcggcgcctattcgatg
ggctacgacccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttgggggactacacctggacggacttctcaaaggtggcctcgggcaaatatactgccaactacctcgacttccacccgaacgagctccatg
cgggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctatgctccctgggtcgtcaaggactggctgaactggt
ggggaggctgggcggttggagagtactgggacaccaacgtcgacgctgttctcaactgggcatactcgagcggtgccaaggtctttgacttcg
ccctctactacaagatggacgaggccttcgataacaacaacattcccgccctggtggacgccctcagatacggtcagacagtggtcagccgcg
acccgttcaaggctgtgacgtttgtagccaaccacgataccgatataatctggaacaagtatccagcctacgcgttcatcctcacctacgagggc
cagccgacaatattctaccgcgactacgaggagtggctcaacaaggataagctcaagaacctcatctggatacatgacaacctcgccggagg
aagcactgacatcgtttactacgacaacgacgagctgatattcgcgagaaacggctacggaagcaagccgggactgataacatacatcaacct
cgcctcaagcaaagccggaaggtgggtttacgttccgaagttcgcaggctcgtgcatacacgagtacaccggcaatctcggcggctggtgg
acaagtgggtggactcaagcggctgggtctacctcgaggctcctgcccacgacccggccaacggccagtacggctactccgtctggagctac
tgcggtgttgggtga SEQ ID NO.: 10
Met Ala Lys Tyr Ser Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Asn Asn Ile Pro Ala Leu Val Asp Ala Leu Arg Tyr Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Ala Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ser Cys Ile His Glu

FIGURE 16D

Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Gln Tyr Gly Tyr Ser Val Trp Ser Tyr Cys Gly Val Gly

SEQ ID NO.: 11
atggccaagtacctggagctcgaggagggcgggctcataatgcaggccttctactgggacgtcccatgggaggaatctggtgggacacgat
agcccagaagatacccgactgggcaagcgccgggatttcggcgatatggattccccggcgagcaagggcatgggcggcgcctattcgatg
ggctacgacccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctatgctccctgggtcgtcaaggactggctgaactggt
ggggaggctgggcggttggagagtactgggacaccaacgtcgacgctgttctcaactgggcatactcgagcggtgccaaggtctttgacttcg
ccctctactacaagatggacgaggccttcgataacaacaacattcccgccctggtggacgccctcagatacggtcagacagtggtcagccgcg
acccgttcaaggctgtgacgtttgtagccaaccacgataccgatataatctggaacaagtatccagcctacgcgttcatcctcacctacgagggc
cagccgacaatattctaccgcgactacgaggagtggctcaacaaggatacgctcaagaacctcatctggatacatgacaacctcgccggagg
aagcacgagcatagtttactacgacagcgacgagatgatcttcgtgagggaacggctatggaagcaagcctggccttataacttacatcaacctc
ggctcgagcaaggttggaaggtgggtctacgttccgaagttcgcgggagcgtgcatccacgagtacaccggcaacctcggcggctgggtgg
acaagtgggtggactcaagcgggtgggtgtacctcgaggcccctgcccatgacccggccaacggctattacggctactccgtctggagctac
tgcggtgttggctga SEQ ID NO.: 12
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Asn Asn Ile Pro Ala Leu Val Asp Ala Leu Arg Tyr Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Thr Leu Lys Asn Leu Ile Trp Ile His Asp Asn Leu Ala Gly Gly Ser Thr Ser Ile Val Tyr
Tyr Asp Ser Asp Glu Met Ile Phe Val Arg Asn Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Gly Val Gly SEQ ID NO.: 13
atggccaagtacctggagctcgaagagggcgggtcataatgcaggcgttctactgggacgtgccttcaggaggaatatggtgggacacaat
acggcagaagatacccggagtggtacgatgccggaatctccgcaatatggattccccggcgagcaagggcatgggcggcgcctattcgatg
ggctacgacccctacgacttctttgacctcggtgagtatgaccagaaggggaacggtagagacgcgctttggctccaagcaggagctcgtgaac
atgataaacacggcacatgcctacggcataaaggtcatagcggacatcgtcataaaccaccgcgcaggcggagacctcgagtggaacccgtt
cgttggggactacacctggacggacttctcaaaggtggcctcgggcaaatatactgccaactacctcgacttccacccaacgaggtcaagtg
ctgtgacgggcacatttggaggcttcccagacatagcccacgagaagagctgggaccagcactggctctgggcgagcgatgagagctac
gccgcctacctaaggagcatcggcgttgatgcctggcgcttcgactacgtcaagggctacggagcgtgggtcgtcaaggactggctggactg
gtggggaggctgggccgtcggggagtactgggacacaaacgttgatgcactgctcaactgggcctactcgagcgatgcaaaagtcttcgactt

FIGURE 16E cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatctggaacaagtatccagcctacgcgttcatcctcacctacgaggg
ccagccgacaatattctaccgcgactacgaggagtggctcaacaaggataagctcaagaacctcatctggatacatgacaacctcgccggag
gaagcactgacatagtctactacgataacgatgaactcatcttcgtcaggaacggctacggggacaagccggggcttataacctacatcaacct
aggctcgagcaaggccggaaggtgggtttatgtgccgaagttcgcgggcgcgtgcatccacgagtatactggtaacctcggaggctgggtag
acaagtacgtctactcaagcggctgggtctatctcgaagctccagcttacgaccctgccaacgggcagtatggctactccgtgtggagctactg
cggtgttggctga SEQ ID NO.: 14
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asp Trp Trp Gly Gly Trp Ala Val Gly Glu Tyr Trp Asp Thr Asn Val Asp.
Ala Leu Leu Asn Trp Ala Tyr Ser Ser Asp Ala Lys Val Phe Asp Phe Pro Leu Tyr Tyr Lys Met Asp
Glu Ala Phe Asp Asn Lys Asn Ile Pro Ala Leu Val Ser Ala Leu Gln Asn Gly Gln Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Ala Gly Gly Ser Thr Asp Ile Val
Tyr Tyr Asp Asn Asp Glu Leu Ile Phe Val Arg Asn Gly Tyr Gly Asp Lys Pro Gly Leu Ile Thr Tyr
Ile Asn Leu Gly Ser Ser Lys Ala Gly Arg Trp Val Tyr Val Pro Lys Phe Ala Gly Ala Cys Ile His
Glu Tyr Thr Gly Asn Leu Gly Gly Trp Val Asp Lys Tyr Val Tyr Ser Ser Gly Trp Val Tyr Leu Glu
Ala Pro Ala Tyr Asp Pro Ala Asn Gly Gln Tyr Gly Tyr Ser Val Trp Ser Tyr Cys Gly Val Gly SEQ ID NO.: 15
atggccaagtactccgagctggaagagggcgggctcataatgcaggccttctactgggacgtccccatgggaggaatctggtgggacacgat
agcccagaagataccgactgggcaagcgccgggatttcggcgatatggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccacccgaacgagctccatg
cgggcgattccggaacatttgaaggctatcccgacatatgccacgacaagagctgtggaccagtactggctotgggcaagccaggagagctac
ggggcatatctcaagatcataggagtcgatgcctgccggtttgactatgttaaggtctacggagctggtgttcaaggactggttgaatg
gtgggggaggctggggcgtcggggagtactggacacaaacgttgatgcactgctcaactgggcctactcgagcgatgcaaaagtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatttggaacaagtacccggcctacgccttcatcctcacctacgaggg
ccagccgacatattctaccgcgactacgaggagtggctcaacaaggacaggctcaagaacctcatctggatacacgaccaccttgccggtg
gaagcactgacatcgtttactacgacaacgacgagctgatattcgtgagaaacggctacggaagcaagccgggactgataacatacatcaacc
tcgcctcaagcaaagccggaaggtgggtttatgtgccgaagttcgcgggcgcgtgcatccacgagtatactggtaacctcggaggctgggtag
acaagtacgtctactcaagcggctgggtctatctcgaagctccagcttacgaccctgccaacgggcagtatggctactccgtgtggagctattgc
ggtgttgggtga SEQ ID NO.: 16
Met Ala Lys Tyr Ser Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp

FIGURE 16F

Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Trp Val
Val Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Arg Leu Lys Asn Leu Ile Trp Ile His Asp His Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly

SEQ ID NO.: 17
atggccaagtactccgagctggaaggggggcgggctcataatgcaggccttctactgggacgtccccatgggaggaatctggtgggacacgat
agcccagaagataccccgactgggcaagcgccgggatttcggcgatatggattcccccggcgagcaagggcatgggcggcgcctattcgatg
ggctacgaccccctacgacttctttgacctcggtgagtacgaccaggagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccaccccaacgaggtcaagt
gctgtgacgagggcacatttggaggcttcccagacatagcccacgagaagagctgggaccagcactggctctgggcgagcgatgagagcta
cgccgcctacctaaggagcatcggcgttgatgcctggcgcttcgactacgtcaagggctacggagcgtgggtcgtcaaggactggctggact
ggtggggaggctgggccgtcggggagtactgggacacaaacgttgatgcactgctcaactgggcctactcgagcgatgcaaaagtcttcgac
ttcccgctctactacaagatggacgcggcctttgacaacaagaacattcccgcactcgtcgaggccctcaagaacgggggcacagtcgtcagc
cgcgacccgtttaaggccgtaaccttcgttgcaaaccacgacaccgatataatctggaacaagtatccagcctacgcgttcatcctcacctacga
gggccagccgacaatattctaccgcgactacgaggagtggctcaacaaggataagctcaagaacctcatctggatacatgacaacctcgccg
gaggaagcacgagcatagtttactacgacagcgacgagatgatcttcgtgaggaacggctatggaagcaagcctggccttataacttacatcaa
cctcggctcgagcaaggttggaaggtgggtttacgttccgaagttcgcaggctcgtgcatacacgagtacaccggcaatctcggcggctgggt
ggacaagtgggtggactcaagcggctgggtctacctcgaggctcctgcccacgacccggccaacggccagtacggctactccgtctggagc
tactgcggtgttggggtga SEQ ID NO.: 18
Met Ala Lys Tyr Ser Glu Leu Glu Gly Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Gly Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asp Trp Trp Gly Gly Trp Ala Val Gly Glu Tyr Trp Asp Thr Asn Val Asp
Ala Leu Leu Asn Trp Ala Tyr Ser Ser Asp Ala Lys Val Phe Asp Phe Pro Leu Tyr Tyr Lys Met Asp
Ala Ala Phe Asp Asn Lys Asn Ile Pro Ala Leu Val Glu Ala Leu Lys Asn Gly Gly Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Ala Gly Gly Ser Thr Ser Ile Val

FIGURE 16G

Tyr Tyr Asp Ser Asp Glu Met Ile Phe Val Arg Asn Gly Tyr Gly Ser Lys Pro Gly Leu Ile Thr Tyr
Ile Asn Leu Gly Ser Ser Lys Val Gly Arg Trp Val Tyr Val Pro Lys Phe Ala Gly Ser Cys Ile His
Glu Tyr Thr Gly Asn Leu Gly Gly Trp Val Asp Lys Trp Val Asp Ser Ser Gly Trp Val Tyr Leu Glu
Ala Pro Ala His Asp Pro Ala Asn Gly Gln Tyr Gly Tyr Ser Val Trp Ser Tyr Cys Gly Val Gly

SEQ ID NO.: 19
atggccaagtacctggagctcgaagagggcgggctcataatgcaggccttctactgggacgtcccatgggaggaatctggtgggacacgat
agcccagaagataccogactgggcaagcgccgggattcggcgatatggattcctcccgcgagcaagggtatgagcggcggctattcgatgg
gctacgaccccctacgattatttttgaccttggtgagtactaccagaagggaacggtggaaacgaggttcggctcaaagcaggagctcataaacat
gataaacacggcccatgcctacggcataaaggtcatagcggacatcgtcataaaccaccgcgcaggcggagacctcgagtggaacccgttc
gttggggactacacctggacggacttctcaaaggtggcctcgggcaaatatactgccaactacctcgacttccacccgaacgagctccatgcg
ggcgattccggaacatttggaggctatcccgacatatgccacgacaagagctgggaccagtactggctctgggccagccaggagagctacgc
ggcatatctcaggagcatcggcatcgatgcctggcgcttcgactacgtcaagggctatgctccctgggtcgtcaaggactggctgaactggtgg
ggggctgggcggttggagagtactgggacaccaacgtcgacgctgttctcaactgggcatactcgagcggtgccaaggtctttgacttcgcc
ctctactacaagatggatgaggcctttgacaacaaaaacattccagcgctcgtctctgccctcagaacggccagactgttgtctcccgcgaccc
gttcaaggccgtaaccttgtagcaaaccacgacaccgatataatttggaacaagtacccggcctacgccttcatcctcacctacgagggccag
ccgacgatattctaccgcgactacgaggagtggctcaacaaggacaggctcaagaacctcatctggatacacgaccacctcgccggtggaag
cactgacatcgtttactacgacaacgacgagctgatattcgtgagaaacggctacggaagcaagcccgggactgataacatacatcaacctcgc
ctcaagcaaagccggaaggtgggtttatgtgccgaagttcgcgggcgcgtgcatccacgagcatactggtaacctcggaggctgggtagaca
agtacgtctactcaagcggctgggtctatctcgaagctccagcttacgaccctgccaacgggcagtatggctactccgtgtggagctactgcgg
tgttggctga SEQ ID NO.: 20
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Glu Ala
Phe Asp Asn Lys Asn Ile Pro Ala Leu Val Ser Ala Leu Gln Asn Gly Gln Thr Val Val Ser Arg Asp
Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Arg Leu Lys Asn Leu Ile Trp Ile His Asp His Leu Ala Gly Gly Ser Thr Asp Ile Val Tyr Tyr
Asp Asn Asp Glu Leu Ile Phe Val Arg Asn Gly Tyr Gly Ser Lys Pro Gly Leu Ile Thr Tyr Ile Asn
Leu Ala Ser Ser Lys Ala Gly Arg Trp Val Tyr Val Pro Lys Phe Ala Gly Ala Cys Ile His Glu His
Thr Gly Asn Leu Gly Gly Trp Val Asp Lys Tyr Val Tyr Ser Ser Gly Trp Val Tyr Leu Glu Ala Pro
Ala Tyr Asp Pro Ala Asn Gly Gln Tyr Gly Tyr Ser Val Trp Ser Tyr Cys Gly Val Gly SEQ ID NO.: 21
atggccaagtactccgagctggaagagggcggcgttataatgcaggccttctactgggacgtcccaggtggaggaatctggtgggacaccat
caggagcaagataccggagtggtacgaggcgggaatatccgccatttggattcctcccgggagcaagggtatgagcggcggctattcgatgg
gctacgaccccctacgatgatttggacctgggtgagtactaccagaagggaacggtggaaacgaggttcggctcaaagcaggagctcataaac
atgataaacacggcccatgcctacggcataaaggtcatagcggacatcgtcataaaccaccgcgcaggcggagacctcgagtggaacccgtt
cgttggggactacacctggacggacttctcaaaggtggcctcgggcaaatatactgccaactacctcgacttccacccgaacgagctccatgc
gggcgattccggaacatttggaggctatcccgacatatgccacgacaagagctgggaccagtactggctctgggccagccaggagagctac

FIGURE 16H gcggtatatctcaggagcatcggcatcgatgcctggcgcttcgactacgtcaagggctacggagcgtgggtcgtcaaggactggctggactg
gtggggaggctgggccgtcggggagtactgggacacaaacgttgatgcactgctcaactgggcctactcgagcgatgcaaaagtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatttggaacaagtacccggcctacgccttcatcctcacctacgaggg
ccagccgacgatattctaccgcgactacgaggagtggctcaacaaggacaggctcaagaacctcatctggatacacgactacctcgccggtg
gaagcactgacatcgtttactacgacaacgacgagctgatattcgtgagaaacggctacggaagcaagccgggactgataacatacatcaacc
tcgcctcaagcaaagccggaaggtgggtttatgtgccgaagttcgcgggcgcgtgcatccacgagtatactggtaacctcggaggctgggtag
acaagtacgtctactcaagcggctgggtctatctcgaagctccagcttacgaccctgccaacgggcagtatggctactccgtgtggagctattgc
ggtgttggctga SEQ ID NO.: 22
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Gly Ser Lys Gly Met Ser Gly Gly Tyr Ser Met Gly Tyr Asp Pro Tyr Asp Asp Leu Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Val
Tyr Leu Arg Ser Ile Gly Ile Asp Ala Trp Arg Phe Asp Tyr Val Lys Gly Tyr Gly Ala Trp Val Val
Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Arg Leu Lys Asn Leu Ile Trp Ile His Asp Tyr Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly SEQ ID NO.: 23
atggccaagtactccgagctggaagagggcggcgttatagtgcaggccttctactgggacgtcccaggtggaggaatctggtgggacaccat
caggagcaagataccggagtggtacgaggcgggaatatccgccatttggattccccggcgagcaagggcatggcggcgcctatcgatg
ggctacgaccctacgacttctttgacctcggtgagtacgaccagaagggaacggtagagacgcgcgcttggctccaagcaggagctcgtgaa
catgataaacatggccatgcctacggcattaaagtcatagcggacatcgtcataaaccacgcgccagggcagacctcgagtggaaccg
ttcgtgggcgactacacttgaccttcttcaaggttgcctcggcaaatatactgctaacttctcggtctgggccgaacgaagcgptcaatg
cgggcgattccggaacatttggaggctatcccgacatatgccacgacaagagctggtaccagtactggctctgggccagccaggagagctac
gcggcatatctcaggagcatcggcatcgatgcctggcgcttcgactacgtcaagggctacggagcgtgggtcgtcaaggactggctggactg
gtggggaggctgggccgtcggggagtactgggacacaaacgttgatgcactgctcaactgggcctactcgagcgatgcaaaagtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatctggaacaagtatccagcctacgcgttcatcctcacctacgaggg
ccagccgacaatattctaccgcgactacgaggagtggctcaacaaggataagctcaagaacctcatctggatacatgacaaoctcgccggag
gaagcatgagcatagtttactacgacagcgacgagatgatcttcgtgaggaacggctatggaagcaagcctggccttataacttacatcaacctc
ggctcgagcaaggttggaaggtgggtctacgttccgaagttcgcgggagcgtgcatccacgagtacaccggcaacctcggcggctgggtgg
acaagtgggtggactcaagcgggtgggtgtacctcgaggcccctgcccacgacccggccaacggctattacggctactccgtctggagctatt
gcggtgttggctga

SEQ ID NO.: 24

FIGURE 16I

Met Ala Lys Tyr Ser Glu Leu Glu Glu Gly Gly Val Ile Val Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Trp Val
Val Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Met Ser Ile Val Tyr
Tyr Asp Ser Asp Glu Met Ile Phe Val Arg Asn Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Gly Val Gly

SEQ ID NO.: 25
atggccaagtacctggagctcgaagagggcgggctcataatgcaggccttctactgggacgtccccatgggaggaatctggtgggacacgat
agcccagaagataccgactgggcaagcgccgggatttcggcgatatggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacaccgcccacgcctatggcatgaaggtaatagccgatatagtcatcaaccaccgcgccggcggtgacctggagtggaacccccttcgt
gaacgactatacctggaccgacttctcaaaggtcgcgtcgggtaaatacacggccaactacctcgacttccacccgaacgagctccatgcggg
cgattccggaacatttggaggctatcccgacatatgccacgacaagagctgggaccagtactggctctgggccagccaggagagctacgcgg
catatctcaggagcatcggcatcgatgcctggcgcttcgactacgtcaagggctatgctccctgggtcgtcaaggactggctgaactggtgggg
aggctgggcggttggagagtactgggacaccaacgtcgacgctgttctcaactgggcatactcgagcggtgccaaggtctttgacttcgccctc
tactacaagatggacgaggccttcgataacaacaacattcccgccctggtgggcgccctcagatacggtcagacagtggtcagccgcgaccc
gttcaaggctgtgacgtttgtagccaaccacgataccgatataatctggaacaagtatccagcctacgcgttcatcctcacctacgagggccagc
cgacaatattctaccgcgactacgaggagtggctcaacaaggataagctcaagaacctcatctggatacatgacaacctcgccggaggaagc
accgacatagtctactacgataacgatgaactcatcttcgtcaggcacggctacggggacaagccggggcttataacctacatcaacctaggct
cgagcaaggccggaaggtggggttttacgttccgaagttcgcaggctcgtgcatacacggagtacaccggcaatctcggcggctgggtggacaa
gtgggtggactcaagcggctgggtctacctcgaggctcctgcccacgacccggccaacggccagtacggctactccgtctggagctattgcg
gtgttgggtga SEQ ID NO.: 26
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Ile Ala Gln Lys Ile Pro Asp Trp Ala Ser Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Met Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Glu Ala
Phe Asp Asn Asn Asn Ile Pro Ala Leu Val Gly Ala Leu Arg Tyr Gly Gln Thr Val Val Ser Arg Asp

FIGURE 16J

Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Lys Leu Lys Asn Leu Ile Trp Ile His Asp Asn Leu Ala Gly Gly Ser Thr Asp Ile Val Tyr Tyr
Asp Asn Asp Glu Leu Ile Phe Val Arg His Gly Tyr Gly Asp Lys Pro Gly Leu Ile Thr Tyr Ile Asn
Leu Gly Ser Ser Lys Ala Gly Arg Trp Val Tyr Val Pro Lys Phe Ala Gly Ser Cys Ile His Glu Tyr
Thr Gly Asn Leu Gly Gly Trp Val Asp Lys Trp Val Asp Ser Ser Gly Trp Val Tyr Leu Glu Ala Pro
Ala His Asp Pro Ala Asn Gly Gln Tyr Gly Tyr Ser Val Trp Ser Tyr Cys Gly Val Gly

SEQ ID NO.: 27
atggcaaagtattccgagctcgaagagggcggcgttataatgcaggccttctactgggacgtcccaggtggaggaatctggtgggacaccatc
aggagcaagataccggagtggtacgaggcgggaatatccgccatttggattcctcccgcgagcaagggtatgagcggcggctattcgatggg
ctacgaccccctacgattattttgacctcggtgagtactaccagaagggaacggtggaaacgaggttcggctcaaagcaggagctcataaacatg
ataaacacggcccatgcctacggcataaaggtcatagcggacatcgtcataaaccaccgcgcaggcggagacctcgagtggaacccgttcgt
tggggactacacctggacggacttctcaaaggtggcctcgggcaaatatactgccaactacctcgacttccacccgaacgagctccatgcggg
cgattccggaacatttggaggctatcccgacatatgccacgacaagagctgggaccagtactggctctgggccagccaggagagctacgcgg
catatctcaggagcatcggcatcgatgcctggcgcttcgactacgtcaagggctatgctccctgggtcgtcaaggactggctgaactggtgggg
aggctgggcggttggagagtactgggacaccaacgtcgacgctgttctcaactgggcatactcgagcggtgccaaggtctttgacttcgccctc
tactacaagatggacgcggcctttgacaacaagaacattcccgcactcgtcgaggccctcaagaacggggcacagtcgtcagccgcgacc
cgtttaaggccgtaaccttcgttgcaaaccacgacaccgatataatctggaacaagtatccagcctacgcgttcatcctcacctacgagggccag
ccgacaatattctaccgcgactacgaggagtggctcaacaaggataagctcaagaacctcatctggatacatgacaacctcgccggaggaag
cactgacatcgtttactacgacaacgacgagctgatattcgtgagaaacggctacggaagcaagccgggactgataacatacatcaacctcgc
gtcaagcaaagccggaaggtgggtttacgttccgaagttcgcaggctcgtgcatacacgagtacaccggcaatctcggcggctgggtggaca
agtgggtggactcaagcggctgggtctacctcgaggctcctgcccacgacccggccaacggccagtacggctactccgtctggagctactgc
ggtgttgggtga SEQ ID NO.: 28
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Ala Ala
Phe Asp Asn Lys Asn Ile Pro Ala Leu Val Glu Ala Leu Lys Asn Gly Gly Thr Val Val Ser Arg Asp
Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Lys Leu Lys Asn Leu Ile Trp Ile His Asp Asn Leu Ala Gly Gly Ser Thr Asp Ile Val Tyr Tyr
Asp Asn Asp Glu Leu Ile Phe Val Arg Asn Gly Tyr Gly Ser Lys Pro Gly Leu Ile Thr Tyr Ile Asn
Leu Ala Ser Ser Lys Ala Gly Arg Trp Val Tyr Val Pro Lys Phe Ala Gly Ser Cys Ile His Glu Tyr
Thr Gly Asn Leu Gly Gly Trp Val Asp Lys Trp Val Asp Ser Ser Gly Trp Val Tyr Leu Glu Ala Pro
Ala His Asp Pro Ala Asn Gly Gln Tyr Gly Tyr Ser Val Trp Ser Tyr Cys Gly Val Gly SEQ ID NO.: 29
atggccaagtacctggagctcgaagagggcgggctcataatgcaggccttctactgggacgtcccatggaggaatctggtgggacacggt
agcccagtagataccgactgggcaagcgccgggatttcggcgatatggattccccggcgagcaagggcatggcggcgcctattcgatg
ggctacgacccctacgacttctttgacctcggtgagtacgaccagaagggaacggtagagacgcgcttggctccaagcaggagctcgtgaa

FIGURE 16K catgataaacacggcccatgcctacggcataaaggtcatagcggacatcgtcataaaccaccgcgcaggcggagacctcgagtggaacccg
ttcgttggggactacacctggacggacttctcaaaggtggtctcgggcaaatatactgccaactacctcgacttccacccgaacgagctccatgc
gggcgattccggaacatttggaggctatcccgacatatgccacgacaagagctgggaccagtactggctctgggccagccaggagagctac
gcggcatatctcaggagcatcggcatcgatgcctggcgcttcgactacgtcaaggcgtatgctccctgggtcgtcaaggactggctgaactggt
ggggaggctgggcggttggagagtactgggacaccaacgtcgacgctgttctcaactgggcatactcgagcggtgccaaggtctttgacttcg
ccctctactacaagatggatgaggcctttgacaacaaaaacattccagcgctcgtctctgcccttcagaacggccagactgttgtctcccgcgac
ccgttcaaggccgtaacctttgtagcaaaccacgacaccgatataatctggaacaagtaccttgcttatgccttcatcctcacctacgaaggccag
cccgtcatattctaccgcgactacgaggagtggctcaacaaggacaggttgaacaacctcatatggatacacgaccacctcgcaggggaag
caccgacatagtctactacgataacgatgaactcatcttcgtcaggaacggctacggggacaagccgggggcttataacctacatcaacctaggc
tcgagcaaggccggaaggtgggtttatgtgccgaagttcgcgggcgcgtgcatccacgagtatactggtaacctcggaggctgggtagacaa
gtacgtctactcaagcggctgggtctatctcgaagctccagcttacgaccctgccaacgggcagtatggctactccgtgtggagctactgcggt
gttgggtga SEQ ID NO.: 30
Met Ala Lys Tyr Leu Glu Leu Glu Glu Gly Gly Leu Ile Met Gln Ala Phe Tyr Trp Asp Val Pro Met
Gly Gly Ile Trp Trp Asp Thr Val Ala Gln Lys Ile Pro Asp Trp Ala Ser Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Val Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Leu Ala
Tyr Ala Phe Ile Leu Thr Tyr Glu Gly Gln Pro Val Ile Phe Tyr Arg Asp Tyr Glu Glu Trp Leu Asn
Lys Asp Arg Leu Asn Asn Leu Ile Trp Ile His Asp His Leu Ala Gly Gly Ser Thr Asp Ile Val Tyr
Tyr Asp Asn Asp Glu Leu Ile Phe Val Arg Asn Gly Tyr Gly Asp Lys Pro Gly Leu Ile Thr Tyr Ile
Asn Leu Gly Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly SEQ ID NO.: 31
atggcaaagtacttcgagctggaagagggcggcgttataatgcaggccttctactgggacgtcccaggtggaggaatctggtggacaccat
caggacccaagatacccgaactggctgagccgccaaatatacgccattgattccccagccgcgagcaagagcatggccggcgccctatggatg
ggctacgaccccctacgacttctttgacctcggtgagtacgaccagaagggaacggtagagacgcgcttggctcaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccacccgaacgagctccatg
cgggcgattccggaacatttggaggctatcccgacatatgccacgacaagagctgggaccagtactggctctgggccagccaggagagctac
gcggcatatctcaggagcatcggcatcgatgcctggcgctttgactacgtgaaggcgtacggagccgtgggtcgtcaaggactggctcaactgg
tggggcggctgggccgttggcgagtactgggacaccaacgttgatgcactcctcaactgggcctactcgagcggcgccaaggtcttcgacttc
ccgctctactacaagatggacgaggccttcgataacaacaacattcccgccctggtggacgccctcagatacggtcagacagtggtcagccgc
gacccgttcaaggctgtgacgtttgtagccaaccacgataccgatataatctggaacaagtatccagcctacgcgttcatcctcacctacgaggg
ccagccgacaatattctaccgcgactacgaggagtggctcaacaaggataagctcaagaacctcatctggatacatgacaacctggccggag
gaagcacgagcatagtttactacgacagcgacgagatgatcttcgtgaggaccggctatggaagcaagcctggccttataacttacatcaacct
cggctcgagcaaggttggaaggtgggtttatgtgccgaagttcgcgggcgcgtgcatccacgagtatactggtaacctcggaggctgggtaga
caagtacgtctactcaagcggctgggtctatctcgaagctccagcttacgaccctgccaacgggcagtatggctactccgtgtggagctattgcg
gtgttggctga

FIGURE 16L

SEQ ID NO.: 32
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Arg Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Trp Val
Val Lys Asp Trp Leu Asn Trp Trp Gly Gly Trp Ala Val Gly Glu Tyr Trp Asp Thr Asn Val Asp Ala
Leu Leu Asn Trp Ala Tyr Ser Ser Gly Ala Lys Val Phe Asp Phe Pro Leu Tyr Tyr Lys Met Asp Glu
Ala Phe Asp Asn Asn Ile Pro Ala Leu Val Asp Ala Leu Arg Tyr Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Ser Ile Val Tyr
Tyr Asp Ser Asp Glu Met Ile Phe Val Arg Thr Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly

SEQ ID NO.: 33
atggccaagtactccgagctggaagagggcggggtcataatgcaggcgttctactgggacgtgccttcaggaggaatatggtgggacacaat
acggcagaagataccggagtggtacgatgccggaatctccgcaatatggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacacggcccatgcctacggcataaaggtcatagcggacatcgtcataaaccaccgcgcaggcggagacctcgagtggaacccgttc
gttggggactacacctggacggacttctcaaaggtggcctcgggcaaatatactgccaactacctcgacttccacccgaacgagctccatgcg
ggcgattccggaacatttggaggctatcccgacatatgccacgacaagagctggaccagtactggctctgggccagccaggagagctacgc
ggcatatctcaggagcatcggcatcgatgcctggcgctttgactacgtgaagggctacggagcgtgggtcgtcaaggactggctcaactggtg
gggcggctggccgttggcgagtactgggacaccaacgttgatgcactcctcaactgggcctactcgagcggcgccaaggtcttcgactttcc
gctctactacaagatggacgcggcctttgacaacaagaacattcccgcactcgtcgaggccctcaagaacgggggcacagtcgtcagccgcg
acccgtttaaggccgtaaccttcgttgcaaaccacgacaccgatataatctggaccaagtaccttgcttatgctttcatcctcacctacgaaggcca
gcccgtcatattctaccgcgactacgaggagtggctcaacaaggacaggttgaacaacctcatatggatacacgaccacctcgcaggtggaag
caccgacatagtctactacgataacgatgaactcatcttcgtcaggaacggctacggggacaagccggggcttataacctacatcaacctaggc
tcgagcaaggccggaaggtggttacgttccgaagttcgcaggctcgtgcataeacgagtacaccggcaatctggcggctgggtggacaa
gtggtgaactcaagcggctggtcatectggaggetcctgcacacgaccccggccaacgtcagtacggtactccgtctggaagctactgcg
gtgttggctga SEQ ID NO.: 34
Met Ala Lys Tyr Ser Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Gly Ala Trp Val Val
Lys Asp Trp Leu Asn Trp Trp Gly Gly Trp Ala Val Gly Glu Tyr Trp Asp Thr Asn Val Asp Ala

FIGURE 16M

Leu Leu Asn Trp Ala Tyr Ser Ser Gly Ala Lys Val Phe Asp Phe Pro Leu Tyr Tyr Lys Met Asp Ala
Ala Phe Asp Asn Lys Asn Ile Pro Ala Leu Val Glu Ala Leu Lys Asn Gly Gly Thr Val Val Ser Arg
Asp Pro Phe Lys Ala Val Thr Phe Val Ala Asn His Asp Thr Asp Ile Ile Trp Thr Lys Tyr Leu Ala
Tyr Ala Phe Ile Leu Thr Tyr Glu Gly Gln Pro Val Ile Phe Tyr Arg Asp Tyr Glu Glu Trp Leu Asn
Lys Asp Arg Leu Asn Asn Leu Ile Trp Ile His Asp His Leu Ala Gly Gly Ser Thr Asp Ile Val Tyr
Tyr Asp Asn Asp Glu Leu Ile Phe Val Arg Asn Gly Tyr Gly Asp Lys Pro Gly Leu Ile Thr Tyr Ile
Asn Leu Gly Ser Ser Lys Ala Gly Arg Trp Val Tyr Val Pro Lys Phe Ala Gly Ser Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Gln Tyr Gly Tyr Ser Val Trp Ser Tyr Cys Gly Val Gly

SEQ ID NO.: 35
atggccaagtactccgagctggaagagggcggcgttataatgcaggccttctactggacgtcccaggtggaggaatctggtgggacaccat
caggagcaagataccggagtggtacgaggcgggaatatccgccatttggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacaccgcccacgcctacggcatcaaggtcatcgcagacatagtaatcaaccaccgcgccggaggagaccttgagtggaacccct
tcgtcaatgactacacctggacggacttctcgaaggtcgcttccggcaagtacacggccaactacctcgacttccaccccaacgaggtcaagtg
ctgtgacgagggcacatttggaggcttcccagacatagcccacgagaagagctgggaccagcactggctctgggcgagcgatgagagctac
gccgcctacctaaggagcatcggcgttgatgcctggcgcttcgactacgtcaagggctatgctccctgggtcgtcaaggactggctgaactggt
gggggaggctggccggttggagagtactgggacaccaacgtcgacgctgttctcaactgggcatactcgagcggtgccaaggtctttgacttcg
ccctctactacaagatggacgcggcctttgacaacaagaacattcccgcactcgtcgaggccctcaagaacgggggcacagtcgtcagccgc
gacccgtttaaggccgtaaccttcgttgcaaaccacgacaccgatataatctggaacaagtatccagcctacgcgttcatcctcacctacgaggg
ccagccgacaatattctaccgcgactacgaggagtggctcaacaaggataagctcaagaacctcatctggatacatgacaacgtcgccggag
gaagcaccgacatagtctactacgataacgatgaactcatcttcgtcaggaacggctacggggacaagccggggcttataacctacatcaacct
aggctcgagcaaggccggaaggtgggtttacgttccgaagttcgcaggctcgtgcatacacgagtacaccggcaatctcggcggctgggtgg
acaagtgggtggactcaagcggctgggtctacctcgaggctcctgcccacgacccggccaacggccagtacggctactccgtctggagctac
tgcggtgttgggtga SEQ ID NO.: 36
Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Ala Pro Trp
Val Val Lys Asp Trp Leu Asn Trp Trp Gly Gly Trp Ala Val Gly Glu Tyr Trp Asp Thr Asn Val Asp
Ala Val Leu Asn Trp Ala Tyr Ser Ser Gly Ala Lys Val Phe Asp Phe Ala Leu Tyr Tyr Lys Met Asp
Ala Ala Phe Asp Asn Lys Asn Ile Pro Ala Leu Val Glu Ala Leu Lys Asn Gly Gly Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Val Ala Gly Gly Ser Thr Asp Ile Val
Tyr Tyr Asp Asn Asp Glu Leu Ile Phe Val Arg Asn Gly Tyr Gly Asp Lys Pro Gly Leu Ile Thr Tyr
Ile Asn Leu Gly Ser Ser Lys Ala Gly Arg Trp Val Tyr Val Pro Lys Phe Ala Gly Ser Cys Ile His
Glu Tyr Thr Gly Asn Leu Gly Gly Trp Val Asp Lys Trp Val Asp Ser Ser Gly Trp Val Tyr Leu Glu
Ala Pro Ala His Asp Pro Ala Asn Gly Gln Tyr Gly Tyr Ser Val Trp Ser Tyr Cys Gly Val Gly SEQ ID NO.: 71
atggccaagtacctggagctcgaagagggcggggtcataatgcaggcgttctactgggacgtgccttcaggaggaatatggtgggacacaat

FIGURE 16N acggcagaagataccggagtggtacgatgccggaatctccgcaatatggattccccggcgagcaagggcatggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtagcctcgggcaaatatactgccaactacctcgacttccacccgaacgagctccatg
cgggcgattccggaacatttggaggctatcccgacatatgccacgacaagagctgggaccagtactggctctgggccagccaggagagctac
gcggcatatctcaggagcatcggcatcgatgcctggcgcttcgactacgtcaagggctatgctccctgggtcgtcaaggactggctgaactggt
ggggaggctgggcggttggagagtactgggacaccaacgtcgacgctgttctcaactgggcatactcgagcggtgccaaggtctttgacttcg
ccctctactacaagatggatgaggcctttgacaacaaaaacattccagcgctcgtctctgcccttcagaacggccagactgttgtctcccgcgac
ccgttcaaggccgtaacctttgtagcaaaccacgacaccgatataatctggaacaagtatccagcctacgcgttcatcctcacctacgagggcc
agccgacaatattctaccgcgactacgaggagtggctcaacaaggataagctcaagaacctcatctggatacatgacaacctcgccggagga
agcactgacatcgtttactacgacaacgacgagctgatattcgtgagaaacggctacggaagcaagccgggactgataacatacatcaacctc
gcctcaagcaaagccggaaggtgggtttatgtgccgaagttcgcgggcgcgtgcatccacgagtatactggtaacctcggaggctgggtaga
caagtacgtctactcaagcggctgggtctatctcgaagctccagcttacgaccctgccaacgggcagtatggctactccgtgtggagctactgc
ggggtgggctga SEQ ID NO.: 72
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Ala Pro Trp Val
Val Lys Asp Trp Leu Asn Trp Trp Gly Gly Trp Ala Val Gly Glu Tyr Trp Asp Thr Asn Val Asp Ala
Val Leu Asn Trp Ala Tyr Ser Ser Gly Ala Lys Val Phe Asp Phe Ala Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly SEQ ID NO.: 49
gtggtttatgacgatgtccgctatgacctttatgccgtaggcatgggccgtgtttatcatgttcacgagctcctgcttggAgccaaagcgcgtctct
accgttccttctggtcgtactcaccgaggtcaaagaagtgtaggggtcgtagcccatcgaataggcgccgcccatgcccttgctcgccggg
ggaatccatatcgccgaaatcccggcgcttgcccagtcgggtatcttctgggctatcgtgtcccaccagattcctcccatggggacgtcccagta
gaaggcctgcattatgagcccgccctcttcgagcccggaatactttgccataagttacctcctactagtagattaaaattctgtttcctgtgtgaaatt
gtt SEQ ID NO.: 50
Val Val Tyr Asp Asp Val Arg Tyr Asp Leu Tyr Ala Val Gly Met Gly Arg Val Tyr His Val His Glu
Leu Leu Leu Gly Ala Lys Ala Arg Leu Tyr Arg Ser Leu Leu Val Val Leu Thr Glu Val Lys Glu Val
Val Gly Val Val Ala His Arg Ile Gly Ala Ala His Ala Leu Ala Arg Arg Gly Asn Pro Tyr Arg Arg
Asn Pro Gly Ala Cys Pro Val Gly Tyr Leu Leu Gly Tyr Arg Val Pro Pro Asp Ser Ser His Gly Asp
Val Pro Val Glu Gly Leu His Tyr Glu Pro Ala Leu Phe Glu Pro Gly Ile Leu Cys His Lys Leu Pro
Pro Thr Ser Arg Leu Lys Phe Cys Phe Leu Cys Glu Ile Val

FIGURE 16O

SEQ ID NO.: 51
ATGGCCAAGTACCTGGAGCTCGAAGAGGGCGGGGTCATAATGCAGGCGTTCTACTGGG
ACGTGCCTTCAGGAGGAATATGGTGGGACACAATACGGCAGAAGATACCGGAGTGGT
ACGATGCCGGAATCTCCGCAATATGGATTCCCCCGGCGAGCAAGGGCATGGGCGGCGC
CTATTCGATGGGCTACGACCCCTACGACTTCTTTGACCTCGGTGAGTACGACCAGAAG
GGAACGGTAGAGACGCGCTTTGGCTCCAAGCAGGAGCTCGTGAACATGATAAACACC
GCCCACGCCTATGGCATGAAGGTAATAGCCGATATAGTCATCAACCACCGCGCCGGCG
GTGACCTGGAGTGGAACCCCTTCGTGAACGACTATACCTGGACCGACTTCTCAAAGGT
CGCGTCGGGTAAATACACGGCCAACTACCTCGACTTCCACCCCAACGAGGTCAAGTGC
TGTGACGAGGGCACATTTGGAGGCTTCCCAGACATAGCCCACGAGAAGAGCTGGGAC
CAGCACTGGCTCTGGGCGAGCGATGAGAGCTACGCCGCCTACCTAAGGAGCATCGGCG
TTGATGCCTGGCGCTTTGACTACGTGAAGGGCTACGGAGCGTGGGTCGTCAAGGACTG
GCTCAACTGGTGGGGCGGCTGGGCCGTTGGCGAGTACTGGGACACCAACGTTGATGCA
CTCCTCAACTGGGCCTACTCGAGCGGCGCCAAGGTCTTCGACTTCCCGCTCTACTACAA
GATGGATGAGGCCTTTGACAACAAAAACATTCCAGCGCTCGTCTCTGCCCTTCAGAAC
GGCCAGACTGTTGTCTCCCGCGACCCGTTCAAGGCCGTAACCTTTGTAGCAAACCACG
ACACCGATATAATCTGGAACAAGTATCCAGCCTACGCGTTCATCCTCACCTACGAGGG
CCAGCCGACAATATTCTACCGCGACTACGAGGAGTGGCTCAACAAGGATAAGCTCAAG
AACCTCATCTGGATACATGACAACCTCGCCGGAGGAAGCACTGACATCGTTTACTACG
ACAACGACGAGCTGATATTCGTGAGAAACGGCTACGGAAGCAAGCCGGGACTGATAA
CATACATCAACCTCGCCTCAAGCAAAGCCGGAAGGTGGGTTTACGTTCCGAAGTTCGC
AGGCTCGTGCATACACGAGTACACCGGCAATCTCGGCGGCTGGGTGGACAAGTGGGTG
GACTCAAGCGGCTGGGTCTACCTCGAGGCTCCTGCCCACGACCCGGCCAACGGCCAGT
ACGGCTACTCCGTCTGGAGCTATTGCGGTGTTGGCTGA

SEQ ID NO.: 52
MAKYLELEEGGVIMQAFYWDVPSGGIWWDTIRQKIPEWYDAGISAIWIPPASKGMGGAYS
MGYDPYDFFDLGEYDQKGTVETRFGSKQELVNMINTAHAYGMKVIADIVINHRAGGDLE
WNPFVNDYTWTDFSKVASGKYTANYLDFHPNEVKCCDEGTFGGFPDIAHEKSWDQHWL
WASDESYAAYLRSIGVDAWRFDYVKGYGAWVVKDWLNWWGGWAVGEYWDTNVDAL
LNWAYSSGAKVFDFPLYYKMDEAFDNKNIPALVSALQNGQTVVSRDPFKAVTFVANHDT
DIIWNKYPAYAFILTYEGQPTIFYRDYEEWLNKDKLKNLIWIHDNLAGGSTDIVYYDNDELI
FVRNGYGSKPGLITYINLASSKAGRWVYVPKFAGSCIHEYTGNLGGWVDKWVDSSGWVY
LEAPAHDPANGQYGYSVWSYCGVG

SEQ ID NO.: 37
atggccaagtacctggagctcgaagagggcggggtcataatgcaggcgttctactgggacgtgccttcaggaggaatatggtgggacacaat
acggcagaagataccggagtggtacgatgccggaatctccgcaatatggattccccggcgagcaagggcatgggcggcgcctattcgatg
ggctacgacccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccaccccaacgagctccatgc
gggcgattccggaacatttggaggctatcccgacatatgccacgacaagagctgggaccagtactggctctgggccagccaggagagctac
gcggcatatctcaggagccatcggcatcgatgcctggcgctttgactacgtgaagggctacggagcgcgggtcgtcaaggactggctcaactg
gtggggcggctgggccgttggcgagtactgggacaccaacgttgatgcactcctcaactgggcctactcgagcggcgccaaggtcttcgactt
cccgctctactacaagatggatgaggcctttgacaacaaaaacattccagcgctcgtctctgcccttcagaacggccagactgttgtctcccgcg
acccgttcaaggccgtaacctttgtagcaaaccacgacaccgatataatctggaacaagtatccagcctacgcgttcatcctcacctacgaggg
ccagccgacaatattctatcgcgactacgaggagtggctcaacaaggataagctcaagaacctcatctggatacatgacaacctcgccggagg
aagcactgacatcgtttactacgacaacgacgagctgatattcgtgagaaacggctacggaagcaagccgggactgataacatacatcaacct
cgcctcaagcaaagccggaaggtgggtttacgttccgaagttcgcaggctcgtgcatacacgagtacaccggcaatctcggcggctgggtgg

FIGURE 16P acaagtgggtggactcaagcggctgggtctacctcgaggctcctgcccacgacccggccaacggccagtacggctactccgtctggagctac
tgcggggtggggtga SEQ ID NO.: 38
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys
Tyr Thr Ala Asn Tyr Leu Asp Phe His Pro Asn Glu Leu His Ala Gly Asp Ser Gly Thr Phe Gly Gly
Tyr Pro Asp Ile Cys His Asp Lys Ser Trp Asp Gln Tyr Trp Leu Trp Ala Ser Gln Glu Ser Tyr Ala
Ala Tyr Leu Arg Ser Ile Gly Ile Asp Ala Trp Arg Phe Asp Tyr Val Lys Gly Tyr Gly Ala Arg Val
Val Lys Asp Trp Leu Asn Trp Trp Gly Gly Trp Ala Val Gly Glu Tyr Trp Asp Thr Asn Val Asp Ala
Leu Leu Asn Trp Ala Tyr Ser Ser Gly Ala Lys Val Phe Asp Phe Pro Leu Tyr Tyr Lys Met Asp Glu
Ala Phe Asp Asn Lys Asn Ile Pro Ala Leu Val Ser Ala Leu Gln Asn Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Asp Ile Val Tyr
Tyr Asp Asn Asp Glu Leu Ile Phe Val Arg Asn Gly Tyr Gly Ser Lys Pro Gly Leu Ile Thr Tyr Ile
Asn Leu Ala Ser Ser Lys Ala Gly Arg Trp Val Tyr Val Pro Lys Phe Ala Gly Ser Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Gln Tyr Gly Tyr Ser Val Trp Ser Tyr Cys Gly Val Gly SEQ ID NO.: 39
atggccaagtacctggagctcgaagagggcggggtcataatgcaggcgttctactgggacgtgccttcaggaggaatatggtgggacacaat
acggcagaagataccggagtggtacgatgccggaatctccgcaatatggattcctcccgcgagcagggggtatgagcggcggctattcgatgg
gctacgacccctacgattattttgacctcggtgagtactaccagaagggaacggtggaaacgaggttcggctcaaagcaggagctcataaacat
gataaacaccgcccacgcctatggcatgaaggtaatagccgatatagtcatcaaccaccgcgccggcggtgacctggagtggaacccttcgt
gaacgactataccctggaccgacttctcaaaggtcgcgtcgggtaaatacacggccaactacctcgacttccacccgaacgagctccatgcggg
cgattccggaacatttggaggctatcccgacatatgccacgacaagagctgggaccagtactggctctgggccagccaggagagctacgcgg
catatctcaggagcatcggtatcgatgcctggcgctttgactacgtgaagggctacggagcgtgggtcgtcaaggactggctcaactggtggg
gcggctgggccgttggcgagtactgggacccccaacgttgatgccctcctccctgggcctactcgagcggcgccaaggtcttcgacttccgc
tctactacaagatggatgaggccttgacaacaaaaacattccagcgctcgtctctgcccttcagaacggccagactgttgtctcccgcgacccg
ttcaaggccgtaacctttgtagccaaccacgataccgatataatctggaacaagtatccagcctacgcgttcatcctcacctacgagggccagcc
gacaatattctaccgcgactacgaggagtggctcaacaagaataagctcaaagaacctcatctggataoaatgacaacctcgccggaggaagca
ccgacatagtctactacgataacgatgaactcattctcgtcaggaacgggtacgggagcaagcccgggactgatatccatagatcaaccaaggctc
gagcaaggccggaagatggggtctacgttccgaagttcgcgggggcgtgcatccacgagtacacggcgacctcggcgggctggtggacaa
gtgggtggactcaagcgggtgggtgtacctcgaggcccctgcccacgacccggccaacggctattacggctactccgtctggagctactgcg
gggtgggctga SEQ ID NO.: 40
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Arg Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Met Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala

FIGURE 16Q

Tyr Leu Arg Ser Ile Gly Ile Asp Ala Trp Arg Phe Asp Tyr Val Lys Gly Tyr Gly Ala Trp Val Val
Lys Asp Trp Leu Asn Trp Trp Gly Gly Trp Ala Val Gly Glu Tyr Trp Asp Pro Asn Val Asp Ala Leu
Leu Pro Trp Ala Tyr Ser Ser Gly Ala Lys Val Phe Asp Phe Pro Leu Tyr Tyr Lys Met Asp Glu Ala
Phe Asp Asn Lys Asn Ile Pro Ala Leu Val Ser Ala Leu Gln Asn Gly Gln Thr Val Val Ser Arg Asp
Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Lys Leu Lys Asn Leu Ile Trp Ile His Asp Asn Leu Ala Gly Gly Ser Thr Asp Ile Val Tyr Tyr
Asp Asn Asp Glu Leu Ile Phe Val Arg Asn Gly Tyr Gly Asp Lys Pro Gly Leu Ile Thr Tyr Ile Asn
Leu Gly Ser Ser Lys Ala Gly Arg Trp Val Tyr Val Pro Lys Phe Ala Gly Ala Cys Ile His Glu Tyr
Thr Gly Asn Leu Gly Gly Trp Val Asp Lys Trp Val Asp Ser Ser Gly Trp Val Tyr Leu Glu Ala Pro
Ala His Asp Pro Ala Asn Gly Tyr Tyr Gly Tyr Ser Val Trp Ser Tyr Cys Gly Val Gly

SEQ ID NO.: 41
atggccaagtacctggagctcgaagagggcggggtcataatgcaggcgttctactgggacgtgccttcaggaggaatatggtgggacacaat
acggcagaagataccggagtggtacgatgccggaatctccgcaatatggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacacggcccatgcctacggcataaaggtcatagcggacatcgtcataaaccaccgcgcaggcggagacctcgagtggaacccgttc
gttggggactacacctggacggacttctcaaaggtggcctcgggcaaatatactgccaactacctcgacttccacccgaacgagctccatgcg
ggcgattccggaacatttggaggctatcccgacatgccatgacaagagctgggaccagtactggctctgggccagccaggagagctacgc
ggcatatctcaggagcatcggcatcgatgcctggcgctttgactacgtgaagggctacggagcgtgggtcgtcaaggactggctcaactggtg
gggcggctgggccgttggcgagtactgggacaccaacgttgatgcactcctcaactgggcctactcgagcggcgccaaggtcttcgacttccc
gctctactacaagatggacgcggcctttgacaacaagaacattcccgcactcgtcgaggccctcaagaacgggggcacagtcgtcagccgcg
acccgtttaaggccgtaaccttcgttgcaaaccacgacaccgatataatctggaacaagtatccagcctacgcgttcatcctcacctacgagggc
cagccgacaatattctaccgcgactacgaggagtggctcaacaaggataagctcaagaacctcatctggatacatgacaacctcgccggagg
aagcacgagcatagtttactacgacagcgacgagatgatcttcgtgaggaacggctatggaagcaagcctggcctataacttacatcaacctc
ggctcgagcaaggttggaaggtgggtttatgtgccgaagttcgcgggcgcgtgcatccacgagtatactggtaacctcggaggctgggtagac
aagtacgtctactcaagcggctgggtctatctcgaagctccagcttacgaccctgccaacgggcagtatggctactccgtgtggagctactgcg
gtgttgggtga SEQ ID NO.: 42
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Gly Ala Trp Val Val
Lys Asp Trp Leu Asn Trp Trp Gly Gly Trp Ala Val Gly Glu Tyr Trp Asp Thr Asn Val Asp Ala
Leu Leu Asn Trp Ala Tyr Ser Ser Gly Ala Lys Val Phe Asp Phe Pro Leu Tyr Tyr Lys Met Asp Ala
Ala Phe Asp Asn Lys Asn Ile Pro Ala Leu Val Glu Ala Leu Lys Asn Gly Gly Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Ser Ile Val Tyr
Tyr Asp Ser Asp Glu Met Ile Phe Val Arg Asn Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Tyr Val Tyr Ser Ser Gly Trp Val Tyr Leu Glu Ala
Pro Ala Tyr Asp Pro Ala Asn Gly Gln Tyr Gly Tyr Ser Val Trp Ser Tyr Cys Gly Val Gly

FIGURE 16R

SEQ ID NO.: 43 atggccaagtactccgagctggaagagggcggcgttataatgcaggccttctactgggacgtcccaggtggaggaatctggtgggacaccat
caggagcaagataccggagtggtacgaggcgggaatatccgccatttggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccaccccaacgaggtcaagt
gctgtgacgagggcacatttggaggcttcccagacatagcccacgagaagagctgggaccagcactggctctgggcgagcgatgagagcta
cgccgcctacctaaggagcatcggcgttgatgcctggcgcttcgactacgtcaagggctacggagcgtgggtcgtcaaggactggctggact
ggtggggaggctgggccgtcggggagtactgggacacaaacgttgatgcactgctcaactgggcctactcgagcgatgcaaaagtcttcgac
ttcccgctctactacaagatggatgaggcctttgacaacaaaaacattccagcgctcgtctctgcccttcagaacggccagactgttgtctccgc
gacccgttcaaggccgtaacctttgtagcaaaccacgacaccgatataatctggaacaagtatccagcctacgcgttcatcctcacctacgagg
gccagccgacaatattctaccgcgactacgaggagtggctcaacaaggataagctcaagaacctcatctggatacatgacaacctcgtcggag
gaagcacgagcatagtttactacgacagcgacgagatgatcttcgtgaggaacggctatggaagcaagcctggcctttataacttacatcaacct
cggctcgagcaaggttggaaggtgggtttacgttccgaagttcgcaggctcgtgcatacacgagtacaccggcaatctcggcggctgggtgg
acaagtgggtggactcaagcggctgggtctacctcgaggctcctgcccacgacccggccaacggccagtacggctactccgtctggagctac
tgcggtgttggctga

SEQ ID NO.: 44

Met Ala Lys Tyr Ser Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asp Trp Trp Gly Gly Trp Ala Val Gly Glu Tyr Trp Asp Thr Asn Val Asp
Ala Leu Leu Asn Trp Ala Tyr Ser Ser Asp Ala Lys Val Phe Asp Phe Pro Leu Tyr Tyr Lys Met Asp
Glu Ala Phe Asp Asn Lys Asn Ile Pro Ala Leu Val Ser Ala Leu Gln Asn Gly Gln Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Val Gly Gly Ser Thr Ser Ile Val
Tyr Tyr Asp Ser Asp Glu Met Ile Phe Val Arg Asn Gly Tyr Gly Ser Lys Pro Gly Leu Ile Thr Tyr
Ile Asn Leu Gly Ser Ser Lys Val Gly Arg Trp Val Tyr Val Pro Lys Phe Ala Gly Ser Cys Ile His
Glu Tyr Thr Gly Asn Leu Gly Gly Trp Val Asp Lys Trp Val Asp Ser Ser Gly Trp Val Tyr Leu Glu
Ala Pro Ala His Asp Pro Ala Asn Gly Gln Tyr Gly Tyr Ser Val Trp Ser Tyr Cys Gly Val Gly

SEQ ID NO.: 45 atggccaagtactccgacctggaagagggcggcgttataatgcaggccttctactgggacgtcccaggtggaggaatctggtgggacaccat
caggagcaagataccggagtggtacgaggcgggaatatccgccatttggattccccggcgagcaagggcatgggcggcgcctattcgatg
ggctacgaccccctacgacttctttgacctcggtgagtacgaccagaagggaacggtagagacgcgctttggctccaagcaggagctcgtgaa
catgataaacacggcccatgcctacggcataaaggtcatagcggacatcgtcataaaccaccgcgcaggcggagacctcgagtggaacccg
ttcgttggggactacacctggacggacttctcaaaggtggcctcgggcaaatatactgccaactacctcgacttccaccccaacgaggtcaagt
gctgtgacgagggcacatttggaggcttcccagacatagcccacgagaagagctgggaccagcactggctctgggcgagcgatgagagcta
cgccgcctacctaaggagcatcggcgttgatgcctggcgctttgactacgtgaagggctacggagcgtgggtcgtcaaggactggctcaactg
gtggggcggctgggccgttggcgagtactgggacaccaacgttgatgcactcctcaactgggcctactcgagcggcgccaaggtcttcgactt
cccgctctactacaagatggatgaggcctttgacaacaaaaacattccagcgctcgtctctgcccttcagaacggccagactgttgtctccgcg
acccgttcaaggccgtaacctttgtagcaaaccacgacaccgatataatctggaacaagtatccagcctacgcgttcatcctcacctacgaggg
ccagccgacaatattctaccgcgactacgaggagtggctcaacaaggataagctcaagaacctcatctggatacatgacaacctcgccggag

FIGURE 16S gaagcaccgacatagtctactacgataacgatgaactcatcttcgtcaggaacggctacggggacaagccggggcttataacctacatcaacct
aggctcgagcaaggccggaaggtgggtttatgtgccgaagttcgcgggcgcgtgcatccacgagtatactggtaacctcggaggctgggtag
acaagtacgtctactcaagcggctgggtctatctcgaagctccagcttacgaccctgccaacgggcagtatggctactccgtgtggagctattgc
ggtgttggtgtga SEQ ID NO.: 46
Met Ala Lys Tyr Ser Asp Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Val Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asn Trp Trp Gly Gly Trp Ala Val Gly Glu Tyr Trp Asp Thr Asn Val Asp
Ala Leu Leu Asn Trp Ala Tyr Ser Ser Gly Ala Lys Val Phe Asp Phe Pro Leu Tyr Tyr Lys Met Asp
Glu Ala Phe Asp Asn Lys Asn Ile Pro Ala Leu Val Ser Ala Leu Gln Asn Gly Gln Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Ala Gly Gly Ser Thr Asp Ile Val
Tyr Tyr Asp Asn Asp Glu Leu Ile Phe Val Arg Asn Gly Tyr Gly Asp Lys Pro Gly Leu Ile Thr Tyr
Ile Asn Leu Gly Ser Ser Lys Ala Gly Arg Trp Val Tyr Val Pro Lys Phe Ala Gly Ala Cys Ile His
Glu Tyr Thr Gly Asn Leu Gly Gly Trp Val Asp Lys Tyr Val Tyr Ser Ser Gly Trp Val Tyr Leu Glu
Ala Pro Ala Tyr Asp Pro Ala Asn Gly Gln Tyr Gly Tyr Ser Val Trp Ser Tyr Cys Gly Val Gly SEQ ID NO.: 47
atggccaagtacaccgagctggaagagggcggcgttataatgcaggccttctactgggacgtcccaggtggaggaatctggtgggacaccat
caggagcaagataccggagtggtacgaggcgggaatatccgccatttggattccccggcgagcaagggcatgggcggcgcctatcgatg
ggctacgaccctacgacttctttgacctcggtgagtacgaccagaagggaacggtagagacgcgctttggctccaagcaggagctcgtgaa
catgataaacaccgcccacgcctatggcatgaaggtaatagccgatatagtcatcaaccaccgcgccggcggtgacctggagtggaacccctt
cgtgaacgactatacctggaccgacttctcaaaggtcgcgtcgggtaaatacacggccaactacctcgacttccaccccaacgaggtcaagtg
ctgtgacgagggcacatttggaggcttcccagacatagcccacgagaagagctgggaccagcactggctctgggcgagcgatgagagctac
gccgcctacctaaggagcatcggcgttgatgcctggcgcttgactacgtgaagggctacggagcgtgggtcgtcaaggactggctcaactgg
tggggcggttgggccgttggcgagtactgggacaccaacgttgatgcactcctcaactgggcctactcgagcggcgccaaggtcttcgacttc
ccgtctactacaagatggatgaggccttgacaacaaaaacattccagaagctcgtatctgccttgaggaacgaccagactgttgtctycaggga
ccegttcaaggccgtaaccttgtagcaaaccacgacaccgatataataggaacagggacctgcttgcttcatcctgacctaggaaggaca
gccgtcatattctaccgcgactacgaggagtggctcaacaaggacaggttgaacaacotcatatggatacatgaccacctcgcaggtggaag
cacgagcatagtttactacgacagcgacgagatgatcttcgtgaggaacggctatggaagcaagcctggccttataacttacatcaacctcggct
cgagcaaggttggaaggtgggtttacgttccgaagttcgcaggcccgtgcatacacgagtacaccggcaatctcggcggctgggtggacaag
tgggtggactcaagcggctgggtctacctcgaggctcctgcccacgacccggccaacggccagtacggctactccgtctggagctactgcgg
tgttgggtag SEQ ID NO.: 48
Met Ala Lys Tyr Thr Glu Leu Glu Glu Gly Gly Val Ile Met Gln Ala Phe Tyr Trp Asp Val Pro Gly
Gly Gly Ile Trp Trp Asp Thr Ile Arg Ser Lys Ile Pro Glu Trp Tyr Glu Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Met Lys Val Ile Ala Asp Ile Val Ile Asn His Arg Ala Gly Gly
Asp Leu Glu Trp Asn Pro Phe Val Asn Asp Tyr Thr Trp Thr Asp Phe Ser Lys Val Ala Ser Gly Lys

FIGURE 16T

Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asp Trp Trp Gly Gly Trp Ala Val Gly Glu Tyr Trp Asp Thr Asn Val Asp
Ala Leu Leu Asn Trp Ala Tyr Ser Ser Gly Ala Lys Val Phe Asp Phe Pro Leu Tyr Tyr Lys Met Asp
Glu Ala Phe Asp Asn Lys Asn Ile Pro Ala Leu Val Ser Ala Leu Gln Asn Gly Gln Thr Val Val Ser
Arg Asp Pro Phe Lys Ala Val Thr Phe Val Ala Asn His Asp Thr Asp Ile Ile Trp Asn Lys Tyr Leu
Ala Tyr Ala Phe Ile Leu Thr Tyr Glu Gly Gln Pro Val Ile Phe Tyr Arg Asp Tyr Glu Glu Trp Leu
Asn Lys Asp Arg Leu Asn Asn Leu Ile Trp Ile His Asp His Leu Ala Gly Gly Ser Thr Ser Ile Val
Tyr Tyr Asp Ser Asp Glu Met Ile Phe Val Arg Asn Gly Tyr Gly Ser Lys Pro Gly Leu Ile Thr Tyr
Ile Asn Leu Gly Ser Ser Lys Val Gly Arg Trp Val Tyr Val Pro Lys Phe Ala Gly Pro Cys Ile His
Glu Tyr Thr Gly Asn Leu Gly Gly Trp Val Asp Lys Trp Val Asp Ser Ser Gly Trp Val Tyr Leu Glu
Ala Pro Ala His Asp Pro Ala Asn Gly Gln Tyr Gly Tyr Ser Val Trp Ser Tyr Cys Gly Val Gly

SEQ ID NO.: 53
ATGGCCAAGTACTCCGAGCTGGAAGAGGGCGGCGTTATAATGCAGGCCTTCTACTGGG
ACGTCCCAGGTGGAGGAATCTGGTGGGACACCATCAGGAGCAAGATACCGGAGTGGT
ACGAGGCGGGAATATCCGCCATTTGGATTCCCCCGGCGAGCAAGGGCATGGGCGGCG
CCTATTCGATGGGCTACGACCCCTACGACTTCTTTGACCTCGGTGAGTACGACCAGAA
GGGAACGGTAGAGACGCGCTTTGGCTCCAAGCAGGAGCTCGTGAACATGATAAACAC
GGCCCATGCCTACGGCATAAAGGTCATAGCGGACATCGTCATAAACCACCGCACAGGC
GGAGACCTCGAGTGGAACCCGTTCGTTGGGGACTACACCTGGACGGACTTCTCAAAGG
TGGCCTCGGGCAAATATACTGCCAACTACCTCGACTTCCACCCCAACGAGGTCAAGTG
CTGTGACGAGGGCACATTTGGAGGCTTCCCAGACATAGCCCACGAGAAGAGCTGGGA
CCAGCACTGGCTCTGGGCGAGCGATGAGAGCTACGCCGCCTACCTAAGGAGCATCGGC
GTTGATGCCTGGCGCTTCGACTACGTCAAGGGCTACGGAGCGTGGGTCGTCAAGGACT
GGCTGGACTGGTGGGGAGGCTGGGCCGTCGGGGAGTACTGGGACACAAACGTTGATG
CACTGCTCAACTGGGCCTACTCGAGCGATGCAAAAGTCTTCGACTTCCCGCTCTACTAC
AAGATGGATGAGGCCTTTGACAACAAAAACATTCCAGCGCTCGTCTCTGCCCTTCAGA
ACGGCCAGACTGTTGTCTCCCGCGACCCGTTCAAGGCCGTAACCTTTGTAGCAAACCA
CGACACCGATATAATCTGGAACAAGTATCCAGCCTACGCGTTCATCCTCACCTACGAG
GGCCAGCCAGACAATATTCTACCGCGACTACGAGGAGTGGCTCAACAAGGATAAGCTCA
AGAACCTCATCTGGATACATGACAACCTCGCCGGAGGAAGCACTGACATCGTTTACTA
CGACAACGACGAGCTGATATTCGTGAGAAACGGCTACGGAAGCAAGCCGGGACTGAT
AACATACATCAACCTCGCCTCAAGCAAAGCCGGAAGGTGGGTCTACGTTCCGAAGTTC
GCGGGAGCGTGCATCCACGAGTACACCGGCAACCTCGGCGGCTGGGTGGACAAGTGG
GTGGACTCAAGCGGGTGGGTGTACCTCGAGGCCCCTGCCCACGACCCGGCCAACGGCT
ATTACGGCTACTCCGTCTGGAGCTACTGCGGTGTTGGCTGA

SEQ ID NO.: 54
MAKYSELEEGGVIMQAFYWDVPGGGIWWDTIRSKIPEWYEAGISAIWIPPASKGMGGAYS
MGYDPYDFFDLGEYDQKGTVETRFGSKQELVNMINTAHAYGIKVIADIVINHRTGGDLEW
NPFVGDYTWTDFSKVASGKYTANYLDFHPNEVKCCDEGTFGGFPDIAHEKSWDQHWLW
ASDESYAAYLRSIGVDAWRFDYVKGYGAWVVKDWLDWWGGWAVGEYWDTNVDALL
NWAYSSDAKVFDFPLYYKMDEAFDNKNIPALVSALQNGQTVVSRDPFKAVTFVANHDTD
IIWNKYPAYAFILTYEGQPTIFYRDYEEWLNKDKLKNLIWIHDNLAGGSTDIVYYDNDELIF
VRNGYGSKPGLITYINLASSKAGRWVYVPKFAGACIHEYTGNLGGWVDKWVDSSGWVY
LEAPAHDPANGYYGYSVWSYCGVG

SEQ ID NO.: 55

FIGURE 16U

```
ATGGCCAAGTACCTGGAGCTCGAGGAGGGCGGGGTCATAATGCAGGCGTTCTACTGGG
ACGTGCCTTCAGGAGGAATATGGTGGGACACAATACGGCAGAAGATACCGGAGTGGT
ACGATGCCGGAATCTCCGCAATATGGATTCCCCCGGCGAGCAAGGGCATGGGCGGCGC
CTATTCGATGGGCTACGACCCCTACGACTTCTTTGACCTCGGTGAGTACGACCAGAAG
GGAACGGTAGAGACGCGCTTTGGCTCCAAGCAGGAGCTCGTGAACATGATAAACACC
GCCCACGCCTATGGCATGAAGGTAATAGCCGATATAGTCATCAACCACCGCGCCGGCG
GTGACCTGGAGTGGAACCCCTTCGTGAACGACTATACCTGGACCGACTTCTCAAAGGT
CGCCGTCGGGTAAATACACGGCCAACTACCTCGACTTCCACCCGAACGAGCTCCATGCG
GGCGATTCCGGAACATTTGGAGGCTATCCCGACATATGCCACGACAAGAGCTGGGACC
AGTACTGGCTCTGGGCCAGCCAGGAGAGCTACGCGGCATATCTCAGGAGCATCGGCAT
CGATGCCTGGCGCTTTGACTACGTGAAGGGCTACGGAGCGTGGGTCGTCAAGGACTGG
CTCAACTGGTGGGGCGGCTGGGCCGTTGGCGAGTACTGGGACACCAACGTTGATGCAC
TCCTCAACTGGGCCTACTCGAGCGGCGCCAAGGTCTTCGACTTCCCGCTCTACTACAAG
ATGGATGAGGCCTTTGACAACAAAAACATTCCAGCGCTCGTCTCTGCCCTTCAGAACG
GCCAGACTGTTGTCTCCCGCGACCCGTTCAAGGCCGTAACCTTTGTAGCAAACCACGA
CACCGATATAATCTGGAACAAGTACCTTGCTTATGCTTTCATCCTCACCTACGAAGGCC
AGCCCGTCATATTCTACCGCGACTACGAGGAGTGGCTCAACAAGGACAGGTTGAACAA
CCTCATATGGATACACGACCACCTCGCAGGTGGAAGCACGAGCATAGTTTACTACGAC
AGCGACGAGATGATCTTCGTGAGGAACGGCTATGGAAGCAAGCCTGGCCTTATAACTT
ACATCAACCTCGGCTCGAGCAAGGTTGGAAGGTGGGTTTACGTTCCGAAGTTCGCAGG
CTCGTGCATACACGAGTACACCGGCAATCTCGGCGGCTGGGTGGACAAGTGGGTGGAC
TCAAGCGGCTGGGTCTACCTCGAGGCTCCTGCCCACGACCCGGCCAACGGCCAGTACG
GCTACTCCGTCTGGAGCTATTGCGGTGTTGGCTGA
```

SEQ ID NO.: 56
MAKYLELEEGGVIMQAFYWDVPSGGIWWDTIRQKIPEWYDAGISAIWIPPASKGMGGAYS
MGYDPYDFFDLGEYDQKGTVETRFGSKQELVNMINTAHAYGMKVIADIVINHRAGGDLE
WNPFVNDYTWTDFSKVASGKYTANYLDFHPNELHAGDSGTFGGYPDICHDKSWDQYWL
WASQESYAAYLRSIGIDAWRFDYVKGYGAWVVKDWLNWWGGWAVGEYWDTNVDALL
NWAYSSGAKVFDFPLYYKMDEAFDNKNIPALVSALQNGQTVVSRDPFKAVTFVANHDTD
IIWNKYLAYAFILTYEGQPVIFYRDYEEWLNKDRLNNLIWIHDHLAGGSTSIVYYDSDEMIF
VRNGYGSKPGLITYINLGSSKVGRWVYVPKFAGSCIHEYTGNLGGWVDKWVDSSGWVYL
EAPAHDPANGQYGYSVWSYCGVG

SEQ ID NO.: 57
```
ATGGCCAAGTACCTGGAGCTCGAAGAGAGCGGGGTCATAATGCAGGCGTTCTACTGGG
ACGTGCCTTCAGGAGGAATATGGTGGACACAATACGGCAGAAGATACCGGAGTGGT
ACGATGCCGGAATCTCCGCAATATGGATTCCTCCGCGAGCAAGGGTATGAGCGGCGG
CTATTCGATGGGCTACGACCCCTACGATTATTTTGACCTCGGTGAGTACTACCAGAAGG
GAACGGTGGAAACGAGGTTCGGCTCAAAGCAGGAGCTCATAAACATGATAAACACCG
CCCACGCCTACGGCATCAAGGTCATCGCAGACATAGTAATCAACCACCGCGCCGGAGG
AGACCTTGAGTGGAACCCCTTCGTCAATGACTACACCTGGACGGACTTCTCGAAGGTC
GCTTCCGGCAAGTACACGGCCAACTACCTCGACTTCCACCCCAACGAGGTCAAGTGCT
GTGACGAGGGCACATTTGGAGGCTTCCCAGACATAGCCCACGAGAAGAGCTGGGACC
AGCACTGGCTCTGGGCGAGCGATGAGAGCTACGCCGCCTACCTAAGGAGCATCGGCGT
TGATGCCTGGCGCTTTGACTACGTGAAGGGCTACGGAGCGTGGGTCGTCAAGGACTGG
CTCAACTGGTGGGGTGGCTGGGCCGTCGGGGAGTACTGGGACACAAACGTTGATGCAC
TGCTCAACTGGGCCTACTCGAGCGATGCAAAAGTCTTCGACTTCCCGCTCTACTACAAG
ATGGACGAGGCCTTCGATAACAACAACATTCCCGCCCTGGTGGACGCCCTCAGATACG
GTCAGACAGTGGTCAGCCGCGACCCGTTCAAGGCTGTGACGTTTGTAGCCAACCACGA
```

FIGURE 16V

TACCGATATAATCTGGAACAAGTACCTTGCTTATGCTTTCATCCTCACCTACGAAGGCC
AGCCCGTCATATTCTACCGCGACTACGAGGAGTGGCTCAACAAGGACAGGTTGAACAA
CCTCATATGGATACACGACCACCTCGCAGGTGGAAGCACTGACATCGTTTACTACGAC
AACGACGAGCTGATATTCGTGAGAAACGGCTACGGAAGCAAGCCGGGACTGATAACA
TACATCAACCTCGCCTCAAGCAAAGCCGGAAGGTGGGTCTACGTTCCGAAGTTCGCGG
GAGCGTGCATCCACGAGTACACCGGCAACCTCGGCGGCTGGGTGGACAAGTGGGTGG
ACTCAAGCGGGTGGGTGTACCTCGAGGCCCCTGCCCACGACCCGGCCAACGGCTATTA
CGGCTACTCCGTCTGGAGCTATTGCGGTGTTGGCTGA

SEQ ID NO.: 58
MAKYLELEESGVIMQAFYWDVPSGGIWWDTIRQKIPEWYDAGISAIWIPPASKGMSGGYS
MGYDPYDYFDLGEYYQKGTVETRFGSKQELINMINTAHAYGIKVIADIVINHRAGGDLEW
NPFVNDYTWTDFSKVASGKYTANYLDFHPNEVKCCDEGTFGGFPDIAHEKSWDQHWLW
ASDESYAAYLRSIGVDAWRFDYVKGYGAWVVKDWLNWWGGWAVGEYWDTNVDALL
NWAYSSDAKVFDFPLYYKMDEAFDNNNIPALVDALRYGQTVVSRDPFKAVTFVANHDTD
IIWNKYLAYAFILTYEGQPVIFYRDYEEWLNKDRLNNLIWIHDHLAGGSTDIVYYDNDELIF
VRNGYGSKPGLITYINLASSKAGRWVYVPKFAGACIHEYTGNLGGWVDKWVDSSGWVY
LEAPAHDPANGYYGYSVWSYCGVG

SEQ ID NO.: 59
atggccaagtacctggagctcgaagagggcggggtcataatgcaggcgttctactgggacgtgccttcaggaggaatatggtgggacacaat
acggcagaagatacggagtggtacgatgccggaatctccgcaatatggattcctcccgcgagcaagggtatgagcggcggctattcgatgg
gctacgaccctacgattatttgacctcggtgagtactaccagaagggaacggtggaaacgaggttcggctcaaagcaggagctcataaacat
gataaacaccgcccacgcctacggcatcaaggtcatcgcagacatagtaatcaaccaccgcgccggaggagaccttgagtggaaccccttcg
tcaatgactacacctggacggacttctcgaaggtcgcttccggcaagtacacggccaactacctcgacttccacccgaacgagctccatgcgg
gcgattccggaacatttggaggctatcccgacatatgccacgacaagagctgggaccagtactggctctgggccagccaggagagctacgcg
gcatatctcaggagcatcggcatcgatgcctggcgcttcgactacgtcaagggctatgctccctgggtcgtcaaggactggctgaactggtggg
gaggctgggcggttggagagtactgggacaccaacgtcgacgctgttctcaactgggcatactcgagcggtgccaaggtctttgacttcgccct
ctactacaagatggacgaggccttcgataacaacaacattcccgccctggtggacgccctcagatacggtcagacagtggtcagccgcgacc
cgttcaaggctgtgacgtttgtagccaaccacgataccgatataatttggaacaagtacccggcctacgccttcatcctcacctacgagggccag
ccgacgatattctaccgcgactacgaggagtggctcaacaaggacaggctcaagaacctcatctggatacacgaccacctcgccggtggaag
cactgacatcgtttactacgacaacgacgagctgatattcgtgagaaacggctacggaagcaagccgggactgataaoatacatcaacctcgc
gtcaagcaaagccggaaggtgggtttatgtgccgaagttcgcgggcgcgtgcatccacgagtatactggtaacctcggaggctgggtagaca
agtacgtctactcaagcggctgggtctatctcgaagctccagcttacgaccctgccaacgggcagtatggctactccgtgtggagctattgcggt
gttgggtga SEQ ID NO.: 60
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Glu Ala
Phe Asp Asn Asn Asn Ile Pro Ala Leu Val Asp Ala Leu Arg Tyr Gly Gln Thr Val Val Ser Arg Asp
Pro Phe Lys Ala Val Thr Phe Val Ala Asn His Asp Thr Asp Ile Ile Trp Asn Lys Tyr Pro Ala Tyr

FIGURE 16W

Ala Phe Ile Leu Thr Tyr Glu Gly Gln Pro Thr Ile Phe Tyr Arg Asp Tyr Glu Glu Trp Leu Asn Lys Asp Arg Leu Lys Asn Leu Ile Trp Ile His Asp His Leu Ala Gly Gly Ser Thr Asp Ile Val Tyr Tyr Asp Asn Asp Glu Leu Ile Phe Val Arg Asn Gly Tyr Gly Ser Lys Pro Gly Leu Ile Thr Tyr Ile Asn Leu Ala Ser Ser Lys Ala Gly Arg Trp Val Tyr Val Pro Lys Phe Ala Gly Ala Cys Ile His Glu Tyr Thr Gly Asn Leu Gly Gly Trp Val Asp Lys Tyr Val Tyr Ser Ser Gly Trp Val Tyr Leu Glu Ala Pro Ala Tyr Asp Pro Ala Asn Gly Gln Tyr Gly Tyr Ser Val Trp Ser Tyr Cys Gly Val Gly

SEQ ID NO.: 61
atggccaagtactccgagctgaaaaagggcggggtcataatgcaggcgttctactgggacgtgccttcaggaggaatatggtgggacacaat
acggcagaagataccggagtggtacgaggcgggaatatccgccatttggattcctcccgcgagcaagggtatgagcggcggctattcgatgg
gctacgaccccctacgattattttgacctcggtgagtactaccagaagggaacggtggaaacgaggttcggctcaaagcaggagctcataaacat
gataaacaccgcccacgcctacggcatcaaggtcatcgcagacatagtaatcaaccaccgcgccggaggagaccttgagtggaaccccttcg
tcaatgactacacctggacggacttctcgaaggtcgcttccggcaagtacacggccaactacctcaacttccaccgaacgagctccatgcgg
gcgattccggaacatttggaggctatcccgacatatgccacgacaagagctgggaccagtactggctctgggccagccaggagagctacgcg
gcatatctcaggagcatcggcatcgatgcctggcgcttcgactacgtcaagggctacggagcgtgggtcgtcaaggactggctggactggtg
gggaggctgggccgtcggggagtactgggacacaaacgttgatgcactgctcaactgggcctactcgagcgatgcaaaagtcttcgacttccc
gctctactacaagatggatgaggcctttgacaacaaaaacattccagcgctcgtctctgcccttcagaacggccagactgttgtctcccgcgacc
cgttcaaggccgtaacctttgtagcaaaccatgacaccgatataatctggaacaagtatccagcctacgcgttcatcctcacctacgagggccag
ccgacaatattctaccgcgactacgaggagtggctcaacaaggataagctcaagaacctcatctggatacatgacaacctcgccggaggaag
caccgacatagtctactacgataacgatgaactcatcttcgtcaggaacggctacggggacaagccggggcttataacctacatcaacctaggc
tcgagcaaggccggaaggtgggtctacgttccgaagttcgcgggagcgtgcatccacgagtacaccggcaacctcggcggctgggtggaca
agtgggtggactcaagcgggtgggtgtacctcgaggcccctgcccacgacccggccaacggctattacggctactccgtctggagctactgc
ggggtgggctga SEQ ID NO.: 62
Met Ala Lys Tyr Ser Glu Leu Lys Lys Gly Gly Val Ile Met Gln Ala Phe Tyr Trp Asp Val Pro Ser Gly Gly Ile Trp Trp Asp Thr Ile Arg Gln Lys Ile Pro Glu Trp Tyr Glu Ala Gly Ile Ser Ala Ile Trp Ile Pro Pro Ala Ser Lys Gly Met Ser Gly Gly Tyr Ser Met Gly Tyr Asp Pro Tyr Asp Tyr Phe Asp Leu Gly Glu Tyr Tyr Gln Lys Gly Thr Val Glu Thr Arg Phe Gly Ser Lys Gln Glu Leu Ile Asn Met Ile Asn Thr Ala His Ala Tyr Gly Ile Lys Val Ile Ala Asp Ile Val Ile Asn His Arg Ala Gly Gly Asp Leu Glu Trp Asn Pro Phe Val Asn Asp Tyr Thr Trp Thr Asp Phe Ser Lys Val Ala Ser Gly Lys Tyr Thr Ala Asn Tyr Leu Asn Phe His Pro Asn Glu Leu His Ala Gly Asp Ser Gly Thr Phe Gly Gly Tyr Pro Asp Ile Cys His Asp Lys Ser Trp Asp Gln Tyr Trp Leu Trp Ala Ser Gln Glu Ser Tyr Ala Ala Tyr Leu Arg Ser Ile Gly Ile Asp Ala Trp Arg Phe Asp Tyr Val Lys Gly Tyr Gly Ala Trp Val Val Lys Asp Trp Leu Asp Trp Trp Gly Gly Trp Ala Val Gly Glu Tyr Trp Asp Thr Asn Val Asp Ala Leu Leu Asn Trp Ala Tyr Ser Ser Asp Ala Lys Val Phe Asp Phe Pro Leu Tyr Tyr Lys Met Asp Glu Ala Phe Asp Asn Lys Asn Ile Pro Ala Leu Val Ser Ala Leu Gln Asn Gln Thr Val Val Ser Arg Asp Pro Phe Lys Ala Val Thr Phe Val Ala Asn His Asp Thr Asp Ile Ile Trp Asn Lys Tyr Pro Ala Tyr Ala Phe Ile Leu Thr Tyr Glu Gly Gln Pro Thr Ile Phe Tyr Arg Asp Tyr Glu Glu Trp Leu Asn Lys Asp Lys Leu Lys Asn Leu Ile Trp Ile His Asp Asn Leu Ala Gly Gly Ser Thr Asp Ile Val Tyr Tyr Asp Asn Asp Glu Leu Ile Phe Val Arg Asn Gly Tyr Gly Asp Lys Pro Gly Leu Ile Thr Tyr Ile Asn Leu Gly Ser Ser Lys Ala Gly Arg Trp Val Tyr Val Pro Lys Phe Ala Gly Ala Cys Ile His Glu Tyr Thr Gly Asn Leu Gly Gly Trp Val Asp Lys Trp Val Asp Ser Ser Gly Trp Val Tyr Leu Glu Ala Pro Ala His Asp Pro Ala Asn Gly Tyr Tyr Gly Tyr Ser Val Trp Ser Tyr Cys Gly Val Gly SEQ ID NO.: 63
atggccaagtacctggagctcgaagagggcggggtcataatgcaggcgttctactgggacgtgccttcaggaggaatatggtgggacacaat
acggcagaagataccggagtggtacgatgccggaatctccgcaatatggattccccggcgagcaagggcatgggcggcgcctattcgatg
ggctacgaccccctacgacttctttgacctcggtgagtacgaccagaagggaaacggtagagacgcgctttggctccaagcaggagctcgtgaa
catgataaacacggcccatgcctacggcataaaggccatagcggacatcgtcataaaccaccgcgcaggcggagacctcgagtggaacccg

FIGURE 16X ttcgttggggactacacctggacggacttctcaaaggtggcctcgggcaaatatactgccaactacctcgacttccaccccaacgaggtcaagt
gctgtgacgagggcacatttggaggcttcccagacatagcccacgagaagagctgggaccagcactggctctgggcgagcgatgagagcta
cgccgcctacctaaggagcatcggcgttgatgcctggcgctttgactacgtgaagggctacggagccgtgggtcgtcaaggactggctcaactg
gtggggcggctgggccgttggcgagtactgggacaccaacgttgatgcactcctcaactgggcctactcgagcggcgccaaggtcttcgactt
cccgctctactacaagatggacgcggcctttgacaacaagaacattcccgcactcgtcgaggccctcaagaacgggggcacagtcgtcagcc
gcgacccgtttaaggccgtaaccttcgttgcaaaccacgacaccgatataatctggaacaagtatccagcctacgcgttcatcctcacctacgag
ggccagccgacaatattctaccgcgactacgaggagtggctcaacaaggataagctcaagaacctcatctggatacatgacaacctcgccgg
aggaagcaccgacatagtctactacgataacgatgaactcatcttcgtcaggaacggctacggggacaagccgggcttataacctacatcaa
cctaggctggagcaaggccggaaggtgggttatgtgccgaagttcgcgggcgcgtgcatccacgagtatactggtaacctcggaggctggg
tagacaagtacgtctactcaagcggctgggtctatctcgaagctccagcttacgaccctgccaacgggcagtatggctactccgtgtggagcta
ctgcggggtggggtga SEQ ID NO.: 64
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Phe Phe Asp
Leu Gly Glu Tyr Asp Gln Lys Gly Thr Val Glu Thr Arg Phe Gly Ser Lys Gln Glu Leu Val Asn
Met Ile Asn Thr Ala His Ala Tyr Gly Ile Lys Ala Ile Ala Asp Ile Val Ile Asn His Arg Ala Gly Gly
Asp Leu Glu Trp Asn Pro Phe Val Gly Asp Tyr Thr Trp Thr Asp Phe Ser Lys Val Ala Ser Gly Lys
Tyr Thr Ala Asn Tyr Leu Asp Phe His Pro Asn Glu Val Lys Cys Cys Asp Glu Gly Thr Phe Gly
Gly Phe Pro Asp Ile Ala His Glu Lys Ser Trp Asp Gln His Trp Leu Trp Ala Ser Asp Glu Ser Tyr
Ala Ala Tyr Leu Arg Ser Ile Gly Val Asp Ala Trp Arg Phe Asp Tyr Val Lys Gly Tyr Gly Ala Trp
Val Val Lys Asp Trp Leu Asn Trp Trp Gly Gly Trp Ala Val Gly Glu Tyr Trp Asp Thr Asn Val Asp
Ala Leu Leu Asn Trp Ala Tyr Ser Ser Gly Ala Lys Val Phe Asp Phe Pro Leu Tyr Tyr Lys Met Asp
Ala Ala Phe Asp Asn Lys Asn Ile Pro Ala Leu Val Glu Ala Leu Lys Asn Gly Gly Thr Val Val Ser
Arg Asp Pro Phe Lys Ala Val Thr Phe Val Ala Asn His Asp Thr Asp Ile Ile Trp Asn Lys Tyr Pro
Ala Tyr Ala Phe Ile Leu Thr Tyr Glu Gly Gln Pro Thr Ile Phe Tyr Arg Asp Tyr Glu Glu Trp Leu
Asn Lys Asp Lys Leu Lys Asn Leu Ile Trp Ile His Asp Asn Leu Ala Gly Gly Ser Thr Asp Ile Val
Tyr Tyr Asp Asn Asp Glu Leu Ile Phe Val Arg Asn Gly Tyr Gly Asp Lys Pro Gly Leu Ile Thr Tyr
Ile Asn Leu Gly Trp Ser Lys Ala Gly Arg Trp Val Tyr Val Pro Lys Phe Ala Gly Ala Cys Ile His
Glu Tyr Thr Gly Asn Leu Gly Gly Trp Val Asp Lys Tyr Val Tyr Ser Ser Gly Trp Val Tyr Leu Glu
Ala Pro Ala Tyr Asp Pro Ala Asn Gly Gln Tyr Gly Tyr Ser Val Trp Ser Tyr Cys Gly Val Gly SEQ ID NO.: 65
atggccaagtactccgagctggaagaaggcggcgttataatgcaggccttctactgggacgtcccaggtggaggaatctggtggggcaccat
caggagcaagataccggagtggtacgaggcgggaatatccgccatttggattcctcccgcgagcaagggtatgagcggcggctattcgatgg
gctacgaccccctacgattattttgacctcggcgagtactaccagaaggggacggtggaaacgaggttcggctcaaaggaggagctcataaacat
gataaacacggccacgcctatggcatgaaggtaatagccgatatgtcatcatccaccgcgccggcggtgacctggagtggaaccccttcgt
gaacgactataacctggaccgacttctcaaaggtcgcgtcgggtaaatacacggccaactacctcgacttccaccccgaacgagctccatgcggg
cgattccggaacatttggaggctatcccgacatatgccacgacaagagctgggaccagtactggctctgggccagccaggagagctacgcgg
catatctcaggagcatcggcatcgatgcctggcgcttcgactacgtcaagggctatgctccctgggtcgtcaaggactggctgaactggtgggg
aggctgggcggttggagagtactgggacaccaacgtcgacgctgttctcaactgggcatactcgagcggtgccaaggtctttgacttcgccctc
tactacaagatggacgaggccttcgataacaacaacattcccgccctggtggacgccctcagatacggtcagacagtggtcagccgcgaccc
gttcaaggctgtgacgtttgtagccaaccacgataccgatataatttggaacaagtacccggcctacgccttcatcctcacctacgagggccagc
cgacgatattctaccgcgactacgaggagtggctcaacaaggacaggctcaagaacctcatctggatacacgaccacctcgccggtggaagc
acgagcatagtttactacgacagcgacgagatgatcttcgtgaggaacggctatggaagcaagcctggccttataacttacatcaacctcggctc
gagcaaggttggaaggtgggtttacgttccgaagttcgcaggctcgtgcatacacgagtacaccggcaatctcggcggctgggtggacaagt
gggtggactcaagcggctgggtctacctcgaggctcctgcccacgacccggccaacggccagtacggctactccgtctggagctattgcggt
gttggctga

FIGURE 16Y

SEQ ID NO.: 66
Met Ala Lys Tyr Ser Glu Leu Glu Glu Gly Gly Val Ile Met Gln Ala Phe Tyr Trp Asp Val Pro Gly
Gly Gly Ile Trp Trp Gly Thr Ile Arg Ser Lys Ile Pro Glu Trp Tyr Glu Ala Gly Ile Ser Ala Ile Trp Ile
Pro Pro Ala Ser Lys Gly Met Ser Gly Gly Tyr Ser Met Gly Tyr Asp Pro Tyr Asp Tyr Phe Asp Leu
Gly Glu Tyr Tyr Gln Lys Gly Thr Val Glu Thr Arg Phe Gly Ser Lys Gln Glu Leu Ile Asn Met Ile
Asn Thr Ala His Ala Tyr Gly Met Lys Val Ile Ala Asp Ile Val Ile Asn His Arg Ala Gly Gly Asp
Leu Glu Trp Asn Pro Phe Val Asn Asp Tyr Thr Trp Thr Asp Phe Ser Lys Val Ala Ser Gly Lys Tyr
Thr Ala Asn Tyr Leu Asp Phe His Pro Asn Glu Leu His Ala Gly Asp Ser Gly Thr Phe Gly Gly Tyr
Pro Asp Ile Cys His Asp Lys Ser Trp Asp Gln Tyr Trp Leu Trp Ala Ser Gln Glu Ser Tyr Ala Ala
Tyr Leu Arg Ser Ile Gly Ile Asp Ala Trp Arg Phe Asp Tyr Val Lys Gly Tyr Ala Pro Trp Val Val
Lys Asp Trp Leu Asn Trp Trp Gly Gly Trp Ala Val Gly Glu Tyr Trp Asp Thr Asn Val Asp Ala Val
Leu Asn Trp Ala Tyr Ser Ser Gly Ala Lys Val Phe Asp Phe Ala Leu Tyr Tyr Lys Met Asp Glu Ala
Phe Asp Asn Asn Asn Ile Pro Ala Leu Val Asp Ala Leu Arg Tyr Gly Gln Thr Val Val Ser Arg Asp
Pro Phe Lys Ala Val Thr Phe Val Ala Asn His Asp Thr Asp Ile Ile Trp Asn Lys Tyr Pro Ala Tyr
Ala Phe Ile Leu Thr Tyr Glu Gly Gln Pro Thr Ile Phe Tyr Arg Asp Tyr Glu Glu Trp Leu Asn Lys
Asp Arg Leu Lys Asn Leu Ile Trp Ile His Asp His Leu Ala Gly Gly Ser Thr Ser Ile Val Tyr Tyr
Asp Ser Asp Glu Met Ile Phe Val Arg Asn Gly Tyr Gly Ser Lys Pro Gly Leu Ile Thr Tyr Ile Asn
Leu Gly Ser Ser Lys Val Gly Arg Trp Val Tyr Val Pro Lys Phe Ala Gly Ser Cys Ile His Glu Tyr
Thr Gly Asn Leu Gly Gly Trp Val Asp Lys Trp Val Asp Ser Ser Gly Trp Val Tyr Leu Glu Ala Pro
Ala His Asp Pro Ala Asn Gly Gln Tyr Gly Tyr Ser Val Trp Ser Tyr Cys Gly Val Gly

SEQ ID NO.: 67
atggccaagtacctggagctcgaagagggcggggtcataatgcaggcgttctactgggacgtgccttcggggaggaatatggtgggacacaat
acggcagaagataccggagtggtacgatgccggaatctccgcaatatggattcctcccgcgagcaagggtatgagcggcggctattcgatgg
gctacgaccectacgattattttgacctcggtgagtactaccagaagggaacggtggaaacgaggttcggctcaaagcaggagctcataaacat
gataaacacggcccatgcctacggcataaaggtcatagcggacatcgtcataaaccaccgcgcaggcggagacctcgagtggaacccgttc
gttggggactacacctggacggacttctcaaaggtggcctcgggcaaatatactgccaactacctcgacttccaccccaacgaggtcaagtgct
gtgacgagggcacatttggaggcttcccagacatagcccacgagaagagctgggaccagcactggctctgggcgagcgatgagagctacg
ccgcctacctaaggagcatcggcgttgatgcctggcgcttcgactacgtcaagggctacggagcgtgggtcgtcaaggactggctggactggt
ggggaggctgggccgtcggggagtactgggacacaaacgttgatgcactgctcaactgggcctactcgagcgatgcaaaagtcttcgacttc
ccgctctactacaagatggacgaggccttcgataacaacaacattcccgccctggtggacgccctcagatacggtcagacagtggtcagccgc
gacccgttcaaggctgtgacgtttgtagccaaccacgataccgatataatctggaacaagtatccagcctacgcgttcatcctcacctacgaggg
ccagccgacaatattctaccgcgactacgaggagtggctcaacaaggataagctcaagaacctcatctggatacatgacaacctcgccggag
gaagcacgagcatagtttactacgacagcgacgagatgatcttcgtgaggaacggctatggaagcaagcctggccttataacttacatcaacct
cggctcgagcaaggttggaaggtgggtctacgttccgaagttcgcgggagcgtgcatccacgagtacaccggcaacctcggcggctgggtg
gacaagtggatggactcaagcggtggtgtacctcgaggcccctgccaagaccccggccaacggctattacggctactccgtctggagcta
ctggcgtcgtctga SEQ ID NO.: 68
Met Ala Lys Tyr Leu Glu Leu Glu Glu Gly Gly Val Ile Met Gln Ala Phe Tyr Trp Asp Val Pro Ser
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Ser Gly Gly Tyr Ser Met Gly Tyr Asp Pro Tyr Asp Tyr Phe Asp
Leu Gly Glu Tyr Tyr Gln Lys Gly Thr Val Glu Thr Arg Phe Gly Ser Lys Gln Glu Leu Ile Asn Met
Ile Asn Thr Ala His Ala Tyr Gly Ile Lys Val Ile Ala Asp Ile Val Ile Asn His Arg Ala Gly Gly Asp
Leu Glu Trp Asn Pro Phe Val Gly Asp Tyr Thr Trp Thr Asp Phe Ser Lys Val Ala Ser Gly Lys Tyr
Thr Ala Asn Tyr Leu Asp Phe His Pro Asn Glu Val Lys Cys Cys Asp Glu Gly Thr Phe Gly Gly
Phe Pro Asp Ile Ala His Glu Lys Ser Trp Asp Gln His Trp Leu Trp Ala Ser Asp Glu Ser Tyr Ala
Ala Tyr Leu Arg Ser Ile Gly Val Asp Ala Trp Arg Phe Asp Tyr Val Lys Gly Tyr Gly Ala Trp Val
Val Lys Asp Trp Leu Asp Trp Trp Gly Gly Trp Ala Val Gly Glu Tyr Trp Asp Thr Asn Val Asp Ala
Leu Leu Asn Trp Ala Tyr Ser Ser Asp Ala Lys Val Phe Asp Phe Pro Leu Tyr Tyr Lys Met Asp Glu

FIGURE 16Z

Ala Phe Asp Asn Asn Asn Ile Pro Ala Leu Val Asp Ala Leu Arg Tyr Gly Gln Thr Val Val Ser Arg
Asp Pro Phe Lys Ala Val Thr Phe Val Ala Asn His Asp Thr Asp Ile Ile Trp Asn Lys Tyr Pro Ala
Tyr Ala Phe Ile Leu Thr Tyr Glu Gly Gln Pro Thr Ile Phe Tyr Arg Asp Tyr Glu Glu Trp Leu Asn
Lys Asp Lys Leu Lys Asn Leu Ile Trp Ile His Asp Asn Leu Ala Gly Gly Ser Thr Ser Ile Val Tyr
Tyr Asp Ser Asp Glu Met Ile Phe Val Arg Asn Gly Tyr Gly Ser Lys Pro Gly Leu Ile Thr Tyr Ile
Asn Leu Gly Ser Ser Lys Val Gly Arg Trp Val Tyr Val Pro Lys Phe Ala Gly Ala Cys Ile His Glu
Tyr Thr Gly Asn Leu Gly Gly Trp Val Asp Lys Trp Val Asp Ser Ser Gly Trp Val Tyr Leu Glu Ala
Pro Ala His Asp Pro Ala Asn Gly Tyr Tyr Gly Tyr Ser Val Trp Ser Tyr Cys Val Val Gly

SEQ ID NO.: 73
atggctctggaagagggcgggcttataatgcaggccttctactgggacgtcccaggtggaggaatctggtgggacaccatagcccagaagat
acccgactgggcgagcgccgggatttcggcaatatggattcctcccgcgagtaagggcatgagcggcggctattcgatgggctacgacccct
acgatttcttcgacctcggtgagtactaccagaagggaagcgttgagacccgcttcggatcaaaagaggagcttgtgaacatgataaacaccgc
ccatgctcacaacatgaaggtcatagcggacatagtcatcaaccaccgcgccggcggcgacctggagtggaatcctttcaccaacagctacac
ctggaccgatttctcgaaggtcgcgtcgggcaagtacacggccaactacctcgacttccaccccgaacgagcttcacgcgggcgattccggaa
catttggaggctatccccgacatatgccacgacaagagctgggaccagcactggctctgggccagcaacgaaagctacgccgcctacctccgg
agcatcggcatcgacgcctggcgcttcgactacgtcaagggctacgctccctgggtcgttaagaactggctgaaccggtggggcggctgggc
ggttggagagtactgggacaccaacgtcgatgcactcctgagctgggcctacgacagcggtgctaaagtcttcgacttcccgctctactacaag
atggacgaggccttcgataacaacaacatcccgccctcgtggacgccctcaagaacggaggcacggtcgtcagccgcgacccgttcaaag
ccgtgaccttcgttgccaaccacgataccaacataatctggaacaagtatccggcctacgccttcatcctcacctatgagggacagccggcaat
attctaccgcgactacgaggagtggctcaacaaggacaggctcaggaacctcatctggatacacgaccacctcgcgggaggaagcacagac
atcatctactacgacagcgacgagcttatcttcgtgagaaacggctacggggacaagccgggactgataacctacatcaacctcggctcaagc
aaggccggaaggtgggtctacgttccgaagttcgcaggctcgtgcatacacgagtacaccggcaacctcggcggctggattgacaagtgggt
tgactcaagcggtcgggtctaccttgaggccccgcccacgacccggccaacggccagtacggctactccgtatggagctactgcggtgttg
ggtga SEQ ID NO.: 74
Met Ala Leu Glu Glu Gly Gly Leu Ile Met Gln Ala Phe Tyr Trp Asp Val Pro Gly Gly Gly Ile Trp
Trp Asp Thr Ile Ala Gln Lys Ile Pro Asp Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Phe Phe Asp Leu Gly Glu Tyr
Tyr Gln Lys Gly Ser Val Glu Thr Arg Phe Gly Ser Lys Glu Glu Leu Val Asn Met Ile Asn Thr Ala
His Ala His Asn Met Lys Val Ile Ala Asp Ile Val Ile Asn His Arg Ala Gly Gly Asp Leu Glu Trp
Asn Pro Phe Thr Asn Ser Tyr Thr Trp Thr Asp Phe Ser Lys Val Ala Ser Gly Lys Tyr Thr Ala Asn
Tyr Leu Asp Phe His Pro Asn Glu Leu His Ala Gly Asp Ser Gly Thr Phe Gly Gly Tyr Pro Asp Ile
Cys His Asp Lys Ser Trp Asp Gln His Trp Leu Trp Ala Ser Asn Glu Ser Tyr Ala Ala Tyr Leu Arg
Ser Ile Gly Ile Asp Ala Trp Arg Phe Asp Tyr Val Lys Gly Tyr Ala Pro Trp Val Val Lys Asn Trp
Leu Asn Arg Trp Gly Gly Trp Ala Val Gly Glu Tyr Trp Asp Thr Asn Val Asp Ala Leu Leu Ser Trp
Ala Tyr Asp Ser Gly Ala Lys Val Phe Asp Phe Pro Leu Tyr Tyr Lys Met Asp Glu Ala Phe Asp
Asn Asn Asn Ile Pro Ala Leu Val Asp Ala Leu Lys Asn Gly Gly Thr Val Val Ser Arg Asp Pro Phe
Lys Ala Val Thr Phe Val Ala Asn His Asp Thr Asn Ile Ile Trp Asn Lys Tyr Pro Ala Tyr Ala Phe Ile
Leu Thr Tyr Glu Gly Gln Pro Ala Ile Phe Tyr Arg Asp Tyr Glu Glu Trp Leu Asn Lys Asp Arg Leu
Arg Asn Leu Ile Trp Ile His Asp His Leu Ala Gly Gly Ser Thr Asp Ile Ile Tyr Tyr Asp Ser Asp Glu
Leu Ile Phe Val Arg Asn Gly Tyr Gly Asp Lys Pro Gly Leu Ile Thr Tyr Ile Asn Leu Gly Ser Ser
Lys Ala Gly Arg Trp Val Tyr Val Pro Lys Phe Ala Gly Ser Cys Ile His Glu Tyr Thr Gly Asn Leu
Gly Gly Trp Ile Asp Lys Trp Val Asp Ser Ser Gly Arg Val Tyr Leu Glu Ala Pro Ala His Asp Pro
Ala Asn Gly Gln Tyr Gly Tyr Ser Val Trp Ser Tyr Cys Gly Val Gly SEQ ID NO.: 75
atggctctggaagagggcgggcttataatgcaggccttctactgggacgtcccatgggaggaatctggtgggacacgatagcccagaagat
acccgactgggcaagcgccgggatttcggcgatatggattccccccgcgagcaagggtatgagcggcggctattcgatgggctacgacccct

FIGURE 16AA acgattattttgacctcggtgagtactaccagaagggaacggtggaaacaagattcggctcaaagcaggagctcataaacatgataaacaccg
cccacgcctatggcatgaaggtaatagccgatatagtcatcaaccaccgcgccggcggcgatctggagtggaacccttcgtgaacgactata
cctggaccgacttctcgaaggtcgcgtcgggtaaatacacggccaactacctcgacttccacccgaacgagctccacgcgggcgattccgga
acatttggaggctatcccgacatatgccacgacaagagctgggaccagtactggctctgggccagccaggagagctacgcggcctatctcag
gagcatcggcatcgacgcctggcgcttcgactacgtcaagggctatgctccctgggtcgtcagggactggctgaactggtggggaggctggg
cagttggagagtactgggacaccaacgtcgacgctgttctcaactgggcatactcgagcggtgccaaggtctttgacttcgccctctactacaag
atggacgaggccttcgataacaacaacattcccgccctggtggacgccctcagatacggccagacagtggtcagccgcgacccgttcaaggc
tgtgacgtttgtagccaaccacgataccgacataatctggaacaagtatccagcctacgcgttcatcctcacctacgagggccagccgacaatat
tctaccgcgactacgaggagtggctcaacaaggacaagctcaagaacctcatctggatacatgacaacctgccggagggagcactgacatc
gtttactacgacaacgacgagctgatattcgtgagaaacggctacggaagcaagccgggactgataacatacatcaacctcggctcaagcaaa
gccggaaggtgggtttacgttccgaagttcgcaggctcgtgcatacacgagtacaccggcaatctcggcggctgggtggacaagtgggtgga
ctcaagcggctgggtttacctcgaggctcctgcccacgacccggccaacggccagtacggctactccgtttggagctattgcggtgttgggtga SEQ ID NO.: 76
Met Ala Leu Glu Glu Gly Gly Leu Ile Met Gln Ala Phe Tyr Trp Asp Val Pro Met Gly Gly Ile Trp
Trp Asp Thr Ile Ala Gln Lys Ile Pro Asp Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Tyr Phe Asp Leu Gly Glu Tyr
Tyr Gln Lys Gly Thr Val Glu Thr Arg Phe Gly Ser Lys Gln Glu Leu Ile Asn Met Ile Asn Thr Ala
His Ala Tyr Gly Met Lys Val Ile Ala Asp Ile Val Ile Asn His Arg Ala Gly Gly Asp Leu Glu Trp
Asn Pro Phe Val Asn Asp Tyr Thr Trp Thr Asp Phe Ser Lys Val Ala Ser Gly Lys Tyr Thr Ala Asn
Tyr Leu Asp Phe His Pro Asn Glu Leu His Ala Gly Asp Ser Gly Thr Phe Gly Gly Tyr Pro Asp Ile
Cys His Asp Lys Ser Trp Asp Gln Tyr Trp Leu Trp Ala Ser Gln Glu Ser Tyr Ala Ala Tyr Leu Arg
Ser Ile Gly Ile Asp Ala Trp Arg Phe Asp Tyr Val Lys Gly Tyr Ala Pro Trp Val Val Arg Asp Trp
Leu Asn Trp Trp Gly Gly Trp Ala Val Gly Glu Tyr Trp Asp Thr Asn Val Asp Ala Val Leu Asn Trp
Ala Tyr Ser Ser Gly Ala Lys Val Phe Asp Phe Ala Leu Tyr Tyr Lys Met Asp Glu Ala Phe Asp Asn
Asn Asn Ile Pro Ala Leu Val Asp Ala Leu Arg Tyr Gly Gln Thr Val Val Ser Arg Asp Pro Phe Lys
Ala Val Thr Phe Val Ala Asn His Asp Thr Asp Ile Ile Trp Asn Lys Tyr Pro Ala Tyr Ala Phe Ile
Leu Thr Tyr Glu Gly Gln Pro Thr Ile Phe Tyr Arg Asp Tyr Glu Glu Trp Leu Asn Lys Asp Lys Leu
Lys Asn Leu Ile Trp Ile His Asp Asn Leu Ala Gly Gly Ser Thr Asp Ile Val Tyr Tyr Asp Asn Asp
Glu Leu Ile Phe Val Arg Asn Gly Tyr Gly Ser Lys Pro Gly Leu Ile Thr Tyr Ile Asn Leu Gly Ser Ser
Lys Ala Gly Arg Trp Val Tyr Val Pro Lys Phe Ala Gly Ser Cys Ile His Glu Tyr Thr Gly Asn Leu
Gly Gly Trp Val Asp Lys Trp Val Asp Ser Ser Gly Trp Val Tyr Leu Glu Ala Pro Ala His Asp Pro
Ala Asn Gly Gln Tyr Gly Tyr Ser Val Trp Ser Tyr Cys Gly Val Gly SEQ ID NO.: 77
atggctctggaagagggcggctcataatgcaggccttctactgggacgtccccatgggaggaatctggtggacacgatagcccagaagat
acccgactggccaaagcgccgggattcggcgatatggatccctccgcgaaagggatgaagcggcggctattcgatgggctacgacccct
acgattattttgacctcggtgagtactaccagaagggaacggtggaaacagaagattcggctcaaagcaggagctcataaacatgataaacacc g
cccacgcctatggcatgaaggtaatagccgatatagtcatcaaccaccgcgccggcggtgacctggagtggaacccttcgtgaacgactata
cctggaccgacttctcaaaggtcgcgtcgggtaaatacacggccaactacctcgacttccacccgaacgagctccatgcgggcgattccggaa
catttggaggctatcccgacatatgccacgacaagagctgggaccagtactggctctgggccagccaggagagctacgcggcatatctcagg
agcatcggcatcgatgcctggcgcttcgactacgtcaagggctatgctccctgggtcgtcaaggactggctgaactggtggggaggctgggc
ggttggagagtactgggacaccaacgtcgacgctgttctcaactgggcatactcgagcggtgccaaggtctttgacttcgccctctactacaaga
tggacgaggccttcgataacaacaacattcccgccctggtggacgccctcagatacggtcagacagtggtcagccgcgacccgttcaaggct
gtgacgtttgtagccaaccacgataccgacataatctggaacaagtatccagcctacgcgttcatcctcacctacgagggccagccgacaatatt
ctaccgcgactacgaggagtggctcaacaaggataagctcaagaacctcatctggatacatgacaacctgccggagggagcactgacatcg
tttactacgacaacgacgagctgatattcgtgagaaacggctacggaagcaagccgggactgataacatacatcaacctcgcctcaagcaaag
ccggaaggtgggtttacgttccgaagttcgcaggctcgtgcatacacgagtacaccggcaatctcggcggctgggtggacaagtgggtggac
tcaagcggctgggtctacctcgaggctcctgcccacgacccggccaacggccagtacggctactccgtctggagctactgcggtgttgggtga

FIGURE 16BB

SEQ ID NO.: 78
Met Ala Leu Glu Glu Gly Gly Leu Ile Met Gln Ala Phe Tyr Trp Asp Val Pro Met Gly Gly Ile Trp
Trp Asp Thr Ile Ala Gln Lys Ile Pro Asp Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Tyr Phe Asp Leu Gly Glu Tyr
Tyr Gln Lys Gly Thr Val Glu Thr Arg Phe Gly Ser Lys Gln Glu Leu Ile Asn Met Ile Asn Thr Ala
His Ala Tyr Gly Met Lys Val Ile Ala Asp Ile Val Ile Asn His Arg Ala Gly Gly Asp Leu Glu Trp
Asn Pro Phe Val Asn Asp Tyr Thr Trp Thr Asp Phe Ser Lys Val Ala Ser Gly Lys Tyr Thr Ala Asn
Tyr Leu Asp Phe His Pro Asn Glu Leu His Ala Gly Asp Ser Gly Thr Phe Gly Gly Tyr Pro Asp Ile
Cys His Asp Lys Ser Trp Asp Gln Tyr Trp Leu Trp Ala Ser Gln Glu Ser Tyr Ala Ala Tyr Leu Arg
Ser Ile Gly Ile Asp Ala Trp Arg Phe Asp Tyr Val Lys Gly Tyr Ala Pro Trp Val Val Lys Asp Trp
Leu Asn Trp Trp Gly Gly Trp Ala Val Gly Glu Tyr Trp Asp Thr Asn Val Asp Ala Val Leu Asn Trp
Ala Tyr Ser Ser Gly Ala Lys Val Phe Asp Phe Ala Leu Tyr Tyr Lys Met Asp Glu Ala Phe Asp Asn
Asn Asn Ile Pro Ala Leu Val Asp Ala Leu Arg Tyr Gly Gln Thr Val Val Ser Arg Asp Pro Phe Lys
Ala Val Thr Phe Val Ala Asn His Asp Thr Asp Ile Ile Trp Asn Lys Tyr Pro Ala Tyr Ala Phe Ile
Leu Thr Tyr Glu Gly Gln Pro Thr Ile Phe Tyr Arg Asp Tyr Glu Glu Trp Leu Asn Lys Asp Lys Leu
Lys Asn Leu Ile Trp Ile His Asp Asn Leu Ala Gly Gly Ser Thr Asp Ile Val Tyr Tyr Asp Asn Asp
Glu Leu Ile Phe Val Arg Asn Gly Tyr Gly Ser Lys Pro Gly Leu Ile Thr Tyr Ile Asn Leu Ala Ser Ser
Lys Ala Gly Arg Trp Val Tyr Val Pro Lys Phe Ala Gly Ser Cys Ile His Glu Tyr Thr Gly Asn Leu
Gly Gly Trp Val Asp Lys Trp Val Asp Ser Ser Gly Trp Val Tyr Leu Glu Ala Pro Ala His Asp Pro
Ala Asn Gly Gln Tyr Gly Tyr Ser Val Trp Ser Tyr Cys Gly Val Gly

SEQ ID NO.: 79
atgaagcctgcgaaactcctcgtctttgtgctcgtagtctctatcctcgcggggctctacgcccagcccgcggggggcggccaagtacctggagc
tcgaagagggcggcgtcataatgcaggcgttctactgggacgtgccttcaggaggaatatggtgggacacaatacggcagaagataccgga
gtggtacgatgccggaatctccgcaatatggattccccggcgagcaagggcatgggcggcgcctattcgatgggctacgaccccctacgactt
ctttgacctcggtgagtacgaccagaagggaacggtagagacgcgctttggctccaagcaggagctcgtgaacatgataaacaccgcccacg
cctacggcatcaaggtcatcgcagacatagtaatcaaccaccgcgccggaggagaaccttgagtggaaccccttcgtcaatgactacacctgga
cggacttctcgaaggtcgcttccggcaagtacacggccaactacctcgacttccaccccaacgaggtcaagtgctgcgacgagggcacctttg
gagggttcccggacatagcccacgagaagagctgggaccagtactggctctgggcgagcaacgagagctacgccgcctacctcaggagca
tcggcgttgacgcatggcgcttcgactacgtcaagggctacggagcgtgggtcgtcaaggactggctggactggtggggaggctggccgt
cggggagtactgggacacaaacgttgatgcactgctcaactgggcctactcgagcgatgcaaaagtcttcgacttcccgctctactacaagatg
gacgcggcctttgacaacaagaacattcccgcactcgtcgaggcctcaagaacgggggcacagtcgtcagccgcgacccgtttaaggccgt
aaccttcgttgcaaaccacgacacggacataatttggaacaagtacccggcctacgccttcatcctcacctacgagggccagccgacgatattc
taccgcgactacgaggagtggctcaacaaggacaggctcaagaacctcatctggatacacgaccacctcgccggtggaagcaccgacatag
tctactacgataacgatgaactcatcttcgtcaggaacggctacggggacaagccggggcttataacctacatcaacctaggctcgagcaagg
ccgggaggtgggtctacgttccgaagttcgcgggagcgtgcatccacgagtacaccggcaacctcggcgggtggttggacaagtgggtgga
ctgaagcggtgcgtgtacctcgaggccgacgtgccacgaccggcgaacggctattacggctactccgtctggagctactgcggggtgggct
ga SEQ ID NO.: 80
Met Lys Pro Ala Lys Leu Leu Val Phe Val Leu Val Val Ser Ile Leu Ala Gly Leu Tyr Ala Gln Pro
Ala Gly Ala Ala Lys Tyr Leu Glu Leu Glu Glu Gly Gly Val Ile Met Gln Ala Phe Tyr Trp Asp Val
Pro Ser Gly Gly Ile Trp Trp Asp Thr Ile Arg Gln Lys Ile Pro Glu Trp Tyr Asp Ala Gly Ile Ser Ala
Ile Trp Ile Pro Pro Ala Ser Lys Gly Met Gly Gly Ala Tyr Ser Met Gly Tyr Asp Pro Tyr Asp Phe
Phe Asp Leu Gly Glu Tyr Asp Gln Lys Gly Thr Val Glu Thr Arg Phe Gly Ser Lys Gln Glu Leu Val
Asn Met Ile Asn Thr Ala His Ala Tyr Gly Ile Lys Val Ile Ala Asp Ile Val Ile Asn His Arg Ala Gly
Gly Asp Leu Glu Trp Asn Pro Phe Val Asn Asp Tyr Thr Trp Thr Asp Phe Ser Lys Val Ala Ser Gly
Lys Tyr Thr Ala Asn Tyr Leu Asp Phe His Pro Asn Glu Val Lys Cys Cys Asp Glu Gly Thr Phe
Gly Gly Phe Pro Asp Ile Ala His Glu Lys Ser Trp Asp Gln Tyr Trp Leu Trp Ala Ser Asn Glu Ser
Tyr Ala Ala Tyr Leu Arg Ser Ile Gly Val Asp Ala Trp Arg Phe Asp Tyr Val Lys Gly Tyr Gly Ala

FIGURE 16CC

Trp Val Val Lys Asp Trp Leu Asp Trp Trp Gly Gly Trp Ala Val Gly Glu Tyr Trp Asp Thr Asn Val
Asp Ala Leu Leu Asn Trp Ala Tyr Ser Ser Asp Ala Lys Val Phe Asp Phe Pro Leu Tyr Tyr Lys Met
Asp Ala Ala Phe Asp Asn Lys Asn Ile Pro Ala Leu Val Glu Ala Leu Lys Asn Gly Gly Thr Val Val
Ser Arg Asp Pro Phe Lys Ala Val Thr Phe Val Ala Asn His Asp Thr Asp Ile Ile Trp Asn Lys Tyr
Pro Ala Tyr Ala Phe Ile Leu Thr Tyr Glu Gly Gln Pro Thr Ile Phe Tyr Arg Asp Tyr Glu Glu Trp
Leu Asn Lys Asp Arg Leu Lys Asn Leu Ile Trp Ile His Asp His Leu Ala Gly Gly Ser Thr Asp Ile
Val Tyr Tyr Asp Asn Asp Glu Leu Ile Phe Val Arg Asn Gly Tyr Gly Asp Lys Pro Gly Leu Ile Thr
Tyr Ile Asn Leu Gly Ser Ser Lys Ala Gly Arg Trp Val Tyr Val Pro Lys Phe Ala Gly Ala Cys Ile
His Glu Tyr Thr Gly Asn Leu Gly Gly Trp Val Asp Lys Trp Val Asp Ser Ser Gly Trp Val Tyr Leu
Glu Ala Pro Ala His Asp Pro Ala Asn Gly Tyr Tyr Gly Tyr Ser Val Trp Ser Tyr Cys Gly Val Gly

SEQ ID NO.: 81
atgaagaagtttgtcgccctgttcataaccatgttttcgtagtgagcatggcagtcgttgcacagccagctagcgccgcaaagtattccgagctc
gaagaaggcggcgttataatgcaggccttctactgggacgtcccaggtggaggaatctggtgggacaccatcaggagcaagataccggagt
ggtacgaggcgggaatatccgccatttggattccgccagccagcaaggggatgagcggcggttactcgatgggctacgatccctacgatttctt
tgacctcggcgagtacaaccagaagggaaccatcgaaacgcgctttggctctaaacaggagctcatcaatatgataaacacggcccatgccta
cggcataaaggtcatagcggacatcgtcataaaccaccgcgcaggcggagacctcgagtggaaccccgttcgttggggactacacctggacg
gacttctcaaaggtggcctcgggcaaatatactgccaactacctcgacttccaccccaacgaggtcaagtgctgtgacgagggcacatttggag
gcttcccagacatagcccacgagaagagctggaccagcactggctctgggcgagcgatgagagctacgccgcctacctaaggagcatcg
gcgttgatgcctggcgctttgactacgtgaagggctacggagcgtgggtcgtcaaggactggctcaactggtggggcggctgggccgttggc
gagtactgggacaccaacgttgatgcactcctcaactgggcctactcgagcggcgccaaggtcttcgacttcccgctctactacaagatggatg
aggcctttgacaacaaaaacattccagcgctcgtctctgcccttcagaacggccagactgttgtctcccgcgacccgttcaaggccgtaaccttt
gtagcaaaccacgacaccgatataatctggaacaagtaccttgcttatgctttcatcctcacctacgaaggccagcccgtcatattctaccgcgac
tacgaggagtggctcaacaaggacaggttgaacaacctcatatggatacacgaccacctcgcaggtggaagcacgagcatagtctactacga
cagcgacgagatgatcttcgtgaggaacggctatgaagcaagcctggccttataacttacatcaacctcggctcgagcaaggttggaaggtg
ggtttatgtgccgaagttcgcgggcgcgtgcatccacgagtatactggtaacctcggaggctgggtagacaagtacgtctactcaagcggctg
ggtctatctcgaagctccagcttacgaccctgccaacgggcagtatggctactccgtgtggagctattgcggtgttgggtga SEQ ID NO.: 82
Met Lys Lys Phe Val Ala Leu Phe Ile Thr Met Phe Phe Val Val Ser Met Ala Val Val Ala Gln Pro
Ala Ser Ala Ala Lys Tyr Ser Glu Leu Glu Glu Gly Gly Val Ile Met Gln Ala Phe Tyr Trp Asp Val
Pro Gly Gly Gly Ile Trp Trp Asp Thr Ile Arg Ser Lys Ile Pro Glu Trp Tyr Glu Ala Gly Ile Ser Ala
Ile Trp Ile Pro Pro Ala Ser Lys Gly Met Ser Gly Gly Tyr Ser Met Gly Tyr Asp Pro Tyr Asp Phe
Phe Asp Leu Gly Glu Tyr Asn Gln Lys Gly Thr Ile Glu Thr Arg Phe Gly Ser Lys Gln Glu Leu Ile
Asn Met Ile Asn Thr Ala His Ala Tyr Gly Ile Lys Val Ile Ala Asp Ile Val Ile Asn His Arg Ala Gly
Gly Asp Leu Glu Trp Asn Pro Phe Val Gly Asp Tyr Thr Trp Thr Asp Phe Ser Lys Val Ala Ser Gly
Lys Tyr Thr Ala Asn Tyr Leu Asp Phe His Pro Asn Glu Val Lys Cys Cys Asp Glu Gly Thr Phe
Gly Gly Phe Pro Asp Ile Ala His Glu Lys Ser Trp Asp Gln His Trp Leu Trp Ala Ser Asp Glu Ser
Tyr Ala Ala Tyr Leu Arg Ser Ile Gly Val Asp Ala Trp Arg Phe Asp Tyr Val Lys Gly Tyr Gly Ala
Trp Val Val Lys Asp Trp Leu Asn Trp Trp Gly Gly Trp Ala Val Gly Glu Tyr Trp Asp Thr Asn Val
Asp Ala Leu Leu Asn Trp Ala Tyr Ser Ser Gly Ala Lys Val Phe Asp Phe Pro Leu Tyr Tyr Lys Met
Asp Glu Ala Phe Asp Asn Lys Asn Ile Pro Ala Leu Val Ser Ala Leu Gln Asn Gly Gln Thr Val Val
Ser Arg Asp Pro Phe Lys Ala Val Thr Phe Val Ala Asn His Asp Thr Asp Ile Ile Trp Asn Lys Tyr
Leu Ala Tyr Ala Phe Ile Leu Thr Tyr Glu Gly Gln Pro Val Ile Phe Tyr Arg Asp Tyr Glu Glu Trp
Leu Asn Lys Asp Arg Leu Asn Asn Leu Ile Trp Ile His Asp His Leu Ala Gly Gly Ser Thr Ser Ile
Val Tyr Tyr Asp Ser Asp Glu Met Ile Phe Val Arg Asn Gly Tyr Gly Ser Lys Pro Gly Leu Ile Thr
Tyr Ile Asn Leu Gly Ser Ser Lys Val Gly Arg Trp Val Tyr Val Pro Lys Phe Ala Gly Ala Cys Ile
His Glu Tyr Thr Gly Asn Leu Gly Gly Trp Val Asp Lys Tyr Val Tyr Ser Ser Gly Trp Val Tyr Leu
Glu Ala Pro Ala Tyr Asp Pro Ala Asn Gly Gln Tyr Gly Tyr Ser Val Trp Ser Tyr Cys Gly Val Gly

FIGURE 16DD

SEQ ID NO.: 83
atggctctggaagacggcgggctcataatgcaggccttctactgggatgttcctggaggaggaatctggtgggacacaatagctcaaaagata
cccgaatgggcaagtgcaggaatctcagcgatatggattccaccagcgagtaagggcatgagcggtggttattccatgggctacgatccctac
gatttctttgacctcggcgagtactatcagaaggggacagttgagacgcgcttcggctcaaaggaagaactggtgaacatgataaacaccgca
cactcctacggcataaaggtgatagcagacatagtcataaaccaccgcgccggtggagaccttgagtggaacccttcgtgaacgactatacct
ggacagacttctcaaaagtcgcctccggtaaatatacggccaactaccttgacttccacccaaacgagcttcactgttgtgatgaaggtacctttg
gaggatacccctgatatatgtcacgacaaaagctgggaccagtactggctctgggcgagcagcgaaagctacgctgcctacctcaggagcata
ggggttgacgcctggcgtttcgactacgtcaagggctacggagcatgggttgttaacgactggctcagctggtggggaggctgggccgttgga
gagtactgggacacgaacgttgatgcactcctcaactgggcatacagcagcggcgccaaggtctttgacttcccgctctactacaagatggacg
aagccttcgacaacaccaacatcccggcattagtggatgcactcagatacggccagacagtggtcagccgcgatcccttcaaggcggtaacttt
cgttgccaaccacgatacagatataatctggaacaagtatccggcttatgcattcatccttacctatgagggacagcctgttatattctaccgcgac
tacgaggagtggctcaacaaggataagcttaacaacctcatctggatacacgatcaccttgctggagggagtactgacattgttactacgacag
cgacgagcttatctttgtgagaaacggctatggcaccaaaccaggactgataacctatatcaacctcggctcaagcaaagttggaaggtgggtc
tacgttccaaagttcgccggttcatgcatccacgagtacaccggcaacctcggcggttggatagacaagtacgtctcctccagcggctgggtct
atcttgaggccccagcccacgacccggcgaacggctactacggctactccgtatggagctactgcggggttgggtga SEQ ID NO.: 84
Met Ala Leu Glu Asp Gly Gly Leu Ile Met Gln Ala Phe Tyr Trp Asp Val Pro Gly Gly Gly Ile Trp
Trp Asp Thr Ile Ala Gln Lys Ile Pro Glu Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Phe Phe Asp Leu Gly Glu Tyr
Tyr Gln Lys Gly Thr Val Glu Thr Arg Phe Gly Ser Lys Glu Glu Leu Val Asn Met Ile Asn Thr Ala
His Ser Tyr Gly Ile Lys Val Ile Ala Asp Ile Val Ile Asn His Arg Ala Gly Gly Asp Leu Glu Trp Asn
Pro Phe Val Asn Asp Tyr Thr Trp Thr Asp Phe Ser Lys Val Ala Ser Gly Lys Tyr Thr Ala Asn Tyr
Leu Asp Phe His Pro Asn Glu Leu His Cys Cys Asp Glu Gly Thr Phe Gly Gly Tyr Pro Asp Ile Cys
His Asp Lys Ser Trp Asp Gln Tyr Trp Leu Trp Ala Ser Ser Glu Ser Tyr Ala Ala Tyr Leu Arg Ser
Ile Gly Val Asp Ala Trp Arg Phe Asp Tyr Val Lys Gly Tyr Gly Ala Trp Val Val Asn Asp Trp Leu
Ser Trp Trp Gly Gly Trp Ala Val Gly Glu Tyr Trp Asp Thr Asn Val Asp Ala Leu Leu Asn Trp Ala
Tyr Ser Ser Gly Ala Lys Val Phe Asp Phe Pro Leu Tyr Tyr Lys Met Asp Glu Ala Phe Asp Asn Thr
Asn Ile Pro Ala Leu Val Asp Ala Leu Arg Tyr Gly Gln Thr Val Val Ser Arg Asp Pro Phe Lys Ala
Val Thr Phe Val Ala Asn His Asp Thr Asp Ile Ile Trp Asn Lys Tyr Pro Ala Tyr Ala Phe Ile Leu
Thr Tyr Glu Gly Gln Pro Val Ile Phe Tyr Arg Asp Tyr Glu Glu Trp Leu Asn Lys Asp Lys Leu Asn
Asn Leu Ile Trp Ile His Asp His Leu Ala Gly Gly Ser Thr Asp Ile Val Tyr Tyr Asp Ser Asp Glu
Leu Ile Phe Val Arg Asn Gly Tyr Gly Thr Lys Pro Gly Leu Ile Thr Tyr Ile Asn Leu Gly Ser Ser
Lys Val Gly Arg Trp Val Tyr Val Pro Lys Phe Ala Gly Ser Cys Ile His Glu Tyr Thr Gly Asn Leu
Gly Gly Trp Ile Asp Lys Tyr Val Ser Ser Ser Gly Trp Val Tyr Leu Glu Ala Pro Ala His Asp Pro
Ala Asn Gly Tyr Tyr Gly Tyr Ser Val Trp Ser Tyr Cys Gly Val Gly SEQ ID NO.: 85
atggctctggaagagggcgggcttataatgcaggccattctattgggacgtcccaggtggaggaatctggtgggacaccatagcccagaagata
cccgaatgggcaagtgcaggaatctcagcgatatggattccaccagcgagtaagggaatgagcggtggttattccatgggctacgatccctac
gatttctttgacctcggcgagtactatcagaaggggacagttgagacgcgcttcggctcaaaggaagaactggtgaacatgataaacaccgca
cactcctacggcataaaggtgatagcggacatagtcataaaccaccgcgccggtggaggcctcgagtggaacccctcgtgaacgactatacc
tggacagacttctcaaaagtcgcctccggtaaatatacagccaactaccttgacttccacccaaacgagcttcactgttgtgatgaaggtacctttg
gaggatacccctgatatatgtcacgacaaaagctgggaccagtactggctctgggcgagcagcgaaagctacgctgcctacctcaggagcata
ggggttgacgcctggtgtttcgactacgtcaagggctacggagcctgggttgttaacgactggctcagctggtggggaggctgggccgttgga
gagtactgggacactaacgttgatgcactcctcaactgggcatacaacagcggcgccaaggtctttgacttcccgctctactacaagatggacg
aagccttcgacaataccaacatccccgctttggtttacgccctcaagaatggcgggacagtggtcagccgcgacccattcaaggcggtaactttt
cgttgccaaccacgatacagatataatctggaacaagtatccggcttatgcattcatccttacctatgagggacagcctgttatattctaccgcgac
tacgaggagtggctcaacaaggataagcttaacaacctcatctggatacacgatcaccttgctggagggagtactgacattgttactacgacag
cgacgagcttatctttgtgagaaacggctatggcaccaaaccaggactgataacctatatcaacctcggctcaagcaaagctggaaggtgggtc

FIGURE 16EE tacgttccaaagttcgccggttcatgcatccacgagtacaccggcagcctcggcggttggatagacaagtacgtctcctccagcggctgggtct
accttgaggccccggccacgacccggccaatggccagtatggctactccgtctggagctattgcggggttgggtga SEQ ID NO.: 86
Met Ala Leu Glu Glu Gly Gly Leu Ile Met Gln Ala Phe Tyr Trp Asp Val Pro Gly Gly Gly Ile Trp
Trp Asp Thr Ile Ala Gln Lys Ile Pro Glu Trp Ala Ser Ala Gly Ile Ser Ala Ile Trp Ile Pro Pro Ala
Ser Lys Gly Met Ser Gly Gly Tyr Ser Met Gly Tyr Asp Pro Tyr Asp Phe Phe Asp Leu Gly Glu Tyr
Tyr Gln Lys Gly Thr Val Glu Thr Arg Phe Gly Ser Lys Glu Glu Leu Val Asn Met Ile Asn Thr Ala
His Ser Tyr Gly Ile Lys Val Ile Ala Asp Ile Val Ile Asn His Arg Ala Gly Gly Gly Leu Glu Trp Asn
Pro Phe Val Asn Asp Tyr Thr Trp Thr Asp Phe Ser Lys Val Ala Ser Gly Lys Tyr Thr Ala Asn Tyr
Leu Asp Phe His Pro Asn Glu Leu His Cys Cys Asp Glu Gly Thr Phe Gly Gly Tyr Pro Asp Ile Cys
His Asp Lys Ser Trp Asp Gln Tyr Trp Leu Trp Ala Ser Ser Glu Ser Tyr Ala Ala Tyr Leu Arg Ser
Ile Gly Val Asp Ala Trp Cys Phe Asp Tyr Val Lys Gly Tyr Gly Ala Trp Val Val Asn Asp Trp Leu
Ser Trp Trp Gly Gly Trp Ala Val Gly Glu Tyr Trp Asp Thr Asn Val Asp Ala Leu Leu Asn Trp Ala
Tyr Asn Ser Gly Ala Lys Val Phe Asp Phe Pro Leu Tyr Tyr Lys Met Asp Glu Ala Phe Asp Asn
Thr Asn Ile Pro Ala Leu Val Tyr Ala Leu Lys Asn Gly Gly Thr Val Val Ser Arg Asp Pro Phe Lys
Ala Val Thr Phe Val Ala Asn His Asp Thr Asp Ile Ile Trp Asn Lys Tyr Pro Ala Tyr Ala Phe Ile
Leu Thr Tyr Glu Gly Gln Pro Val Ile Phe Tyr Arg Asp Tyr Glu Glu Trp Leu Asn Lys Asp Lys Leu
Asn Asn Leu Ile Trp Ile His Asp His Leu Ala Gly Gly Ser Thr Asp Ile Val Tyr Tyr Asp Ser Asp
Glu Leu Ile Phe Val Arg Asn Gly Tyr Gly Thr Lys Pro Gly Leu Ile Thr Tyr Ile Asn Leu Gly Ser
Ser Lys Ala Gly Arg Trp Val Tyr Val Pro Lys Phe Ala Gly Ser Cys Ile His Glu Tyr Thr Gly Ser
Leu Gly Gly Trp Ile Asp Lys Tyr Val Ser Ser Ser Gly Trp Val Tyr Leu Glu Ala Pro Ala His Asp
Pro Ala Asn Gly Gln Tyr Gly Tyr Ser Val Trp Ser Tyr Cys Gly Val Gly SEQ ID NO: 87
atgttcctgctcgcgttttttgctcactgcctcgctgttctgcccaacaggacagcccgccaaggctgccgcaccgtttaacggcaccatgatgca
gtattttgaatggtacttgccggatgatggcacgttatggaccaaagtggccaatgaagccaacaacttatccagccttggcatcaccgctctttg
gctgccgcccgcttacaaaggaacaagccgcagcgacgtagggtacggagtatacgaettgtatgacctcggcgaattcaatcaaaaagggga
ccgtccgcacaaaatacggaacaaaagctcaatatcttcaagccattcaagccgcccacgccgctggaatgcaagtgtacgccgatgtcgtgtt
cgaccataaggcggcgctgacggcacggaatgggtggacgccgtcgaagtcaatccgtccgaccgcaaccaagaaatctcgggcacctat
caaatccaagcatggacgaaatttgattttcccgggcggggcaacacctactccagctttaagtggcgctggtaccattttgacggcgttgattgg
gacgaaagccgaaaattgagccgcatttacaaattccgcggcatcggcaaagcgtgggattgggaagtagacacggaaaacggaaactatg
actacttaatgtatgccgaccttgatatggatcatcccgaagtcgtgaccgagctgaaaaactgggggaaatggtatgtcaacacaacgaacatt
gatgggttccggcttgatgccgtcaagcatattaagttcagttttttcctgattggttgtcgtatgtgcgttctcagactggcaagccgctatttaccg
tcggggaatattggagctatgacatcaacaagttgcacaattacattacgaaaacagacggaacgatgtctttgtttgatgcccgttacacaaca
aattttatacggcttccaaatcaggcggcggattgatatgcgcacgttaatgacgaatactctcatgaaagatcaaccagacattggccgtcaccttt
cgttgataatcatgacatcggaaccggccaaggcgtcaagtcatgcctcgctcacatagttctcagaacgttggctcaggctcatttctaatcggg
aggaaggaatcccgtccgtcttttatggtgactattatggcattccacaatataaacattccttcgctgaaaagcaaaatcgatccgctcctcatcgc
gcgcagggattatgcttacggaacgcaacatgattatcttgatcactccgacatcatcgggtggacaaggggaaggggtcactgaaaaaccagg
atccgggctggccgcactgatcaccgatgggccgggaggaagcaaatggatgtactgttggcaaacaacacgctggaaaagtgttctatga SEQ ID NO: 88
Met Phe Leu Leu Ala Phe Leu Leu Thr Ala Ser Leu Phe Cys Pro Thr Gly Gln Pro Ala Lys Ala Ala
Ala Pro Phe Asn Gly Thr Met Met Gln Tyr Phe Glu Trp Tyr Leu Pro Asp Asp Gly Thr Leu Trp Thr
Lys Val Ala Asn Glu Ala Asn Asn Leu Ser Ser Leu Gly Ile Thr Ala Leu Trp Leu Pro Pro Ala Tyr
Lys Gly Thr Ser Arg Ser Asp Val Gly Tyr Gly Val Tyr Asp Leu Tyr Asp Leu Gly Glu Phe Asn Gln
Lys Gly Thr Val Arg Thr Lys Tyr Gly Thr Lys Ala Gln Tyr Leu Gln Ala Ile Gln Ala Ala His Ala
Ala Gly Met Gln Val Tyr Ala Asp Val Val Phe Asp His Lys Gly Gly Ala Asp Gly Thr Glu Trp Val
Asp Ala Val Glu Val Asn Pro Ser Asp Arg Asn Gln Glu Ile Ser Gly Thr Tyr Gln Ile Gln Ala Trp
Thr Lys Phe Asp Phe Pro Gly Arg Gly Asn Thr Tyr Ser Ser Phe Lys Trp Arg Trp Tyr His Phe Asp

FIGURE 16FF

Gly Val Asp Trp Asp Glu Ser Arg Lys Leu Ser Arg Ile Tyr Lys Phe Arg Gly Ile Gly Lys Ala Trp Asp Trp Glu Val Asp Thr Glu Asn Gly Asn Tyr Asp Tyr Leu Met Tyr Ala Asp Leu Asp Met Asp His Pro Glu Val Val Thr Glu Leu Lys Asn Trp Gly Lys Trp Tyr Val Asn Thr Thr Asn Ile Asp Gly Phe Arg Leu Asp Ala Val Lys His Ile Lys Phe Ser Phe Phe Pro Asp Trp Leu Ser Tyr Val Arg Ser Gln Thr Gly Lys Pro Leu Phe Thr Val Gly Glu Tyr Trp Ser Tyr Asp Ile Asn Lys Leu His Asn Tyr Ile Thr Lys Thr Asp Gly Thr Met Ser Leu Phe Asp Ala Pro Leu His Asn Lys Phe Tyr Thr Ala Ser Lys Ser Gly Gly Ala Phe Asp Met Arg Thr Leu Met Thr Asn Thr Leu Met Lys Asp Gln Pro Thr Leu Ala Val Thr Phe Val Asp Asn His Asp Thr Glu Pro Gly Gln Ala Leu Gln Ser Trp Val Asp Pro Trp Phe Lys Pro Leu Ala Tyr Ala Phe Ile Leu Thr Arg Gln Glu Gly Tyr Pro Cys Val Phe Tyr Gly Asp Tyr Tyr Gly Ile Pro Gln Tyr Asn Ile Pro Ser Leu Lys Ser Lys Ile Asp Pro Leu Leu Ile Ala Arg Arg Asp Tyr Ala Tyr Gly Thr Gln His Asp Tyr Leu Asp His Ser Asp Ile Ile Gly Trp Thr Arg Glu Gly Val Thr Glu Lys Pro Gly Ser Gly Leu Ala Ala Leu Ile Thr Asp Gly Pro Gly Gly Ser Lys Trp Met Tyr Cys Trp Gln Thr Thr Arg Trp Lys Ser Val Leu

SEQ ID NO: 89
atgaaagaagcggttgtgtatcaaattttcccggatcggttctttaatggcaacccttcaaatgataacagcaagcagcaggcacgcggggcgc
agccgattgagcatcgcgattggtcggatttgcccgataatccgcgcctgaaagggacgagcggctacgatggcgacggtgaatggtcgaat
gacttttcggcggagacatcgccggaattgaacaaaagttggattatttgcagtcgcttggagtgaacacgatttacttaaatccgatcgccaatg
cgccatcgaaccataaatatgatgcgagcaattacaaagaattggatccgatgttcggttccccggaagaattccaatcgtttgtgcaggcgcttg
cgaaccggggatgcatctcatcttagacggggtgttcaaccacgtatccgacgattcgatttactttgaccgctaccaccgctatccgaccgto
ggtgcgtatgaatattgggaagcggtttacgatttgatgaatgaaaaaggattgagcgaggaagaagcgcggaaacaagtggaagagaagttc
aaacaagagggacagacgttcagcccgtatgggtttcatctttggttcaatattgaaaacaaaaaagtcaatggccattatcaataccaatcatggt
ggggctatgacagtctgccggagtttaagtcggtgacgggggaaaaagtgccgcatccgagtgaattgaacaacgatgcgctcgcgaattac
attttccgtgaatcggattcggtggcgaaaagctggattgccctcggcgcctccggctggcggttggatgtggccaatgaggtggatccggcgt
tttggcgcgagtttcgccaagaattgcttcaagggtcgtacggccgcggtccgacgttaaaagaggggggagcagccgctcattttaggggaaa
tttgggatgacgcatcgaaatattttctaggcgaccagtacgattccgtgatgaactaccggttccgcggggcggtgcttgacttttgaaaaacg
gaaatgcagaagaggcggacaagcggctgacggccataagggaagactacccaagtgaagcgttttatgcgctgatgaacttaatcggttcg
catgacacggcgcgggcggtctttctgcttgggaacggaacggattcatccgagcgggcggagcttgatccgaattataatgaggaacttggg
aaaaagcggctcaagctggcggtgattttgcagatgggatacccgggagcgccgacgatttattacggcgatgaagcgggagtaacaggctc
aaaagacccagacaaccgccgcacgtatccgtggggcaaagaagatcaaaatctgttgtcccattatcagaaagtggggcacattcgccagc
accatcaatcgttgttggcccatggcgacatcaagacggtgtatgcgcaaggggatgtatacgtatttgcccgccaatacgggcgtgaagcgg
cgctcattgccatcaaccgcggcaatgaggacaagacggtggcgcttgacgtcgcttcgttgcttccgaacggcaccgtgcttacggatgagtt
gcatgatggcggggaagctacggtcgctggcggaaegttgacggtcacgattccggccctggatggacggatgatgtttgggacggtgacg
gcggaaatgccggcagcagtcagcaatttgcaggcgagcgcttcggatggctgcgtgacgttaacgtgggaaggaaatgcatcgagatacc
gaatttacgagtccacgttaaaaggtgccggttatacgatggtgcaagagacggaaacaacttcggccacgatcggttcgttgacgaacggaa
cagcctattacttgccgttgcggcggatcgatgaaaagaggaatgaatcaccgaaggtcgaaacgaatcgcgtcgttccteattactcgctgac
gagcgtcaatgtccagttcgttgaacagctttagtgtaacagactggattcgcaagtcggagcaaagtcgatgtccatcgtaaacattcgacaat
gtgacaagcaaaggagcagctgatgggttgccatcggcggttgcaagtgaaggcccgcatgacgaaacatgcaaagaattacagagcggctt
accaaggacaagacggcgacgccaacgtgttccgagctgccttcactccgctcgccgcagggacgtatacgtatcgttatgcgctgacgacc
aaccttggcgaggagtggatgtatacagaagagaagcaagtgacgtttgcggcagacaacagcgaccaaatagcgccagcagacgccatcg
agctgcggcagcctgcggttgaatcgggacaagtgaatttatcatggacgtttgttgggaaaaaagatggggatgcttatttgttagccatcgag
cgcaacggtgatatcgtgcatacaaccacttcgatcggcgattcatttacagactacgatgtcgaaaacggcaccgagtacacgtatgttgtcaa
gttgtatgaccgcgccggcaatgttgtggcgtcaaacacggtcaaggtgacgccggacattgtgatggtgaaagtgattttaaagtgagagcg
ccggattacacaccgttggatgcccgaattacgattccgaacagcttgaacggctggaacacaggggcctgggagatgtcgcgcaacggtgc
ggtgacgcccgattggcaatttaccgtcgaggtgcaggaaggggaaacgatcacctataagtatgtgaaaggcggatcgtgggatcaagagg
ggttggccgaccatacgcgtgaggacgacaacgatgatgacgtgagctactacggctatgggacgattggcaccgacttgaaagtgacggtc
cacaatgaaggaaacaatacgatgattgtgcaagaccgcatttttgcgctggatcgatatgccggtcgtcatcgaagaggtgcaaaaacaagga
agtcaagtgacgatcaagggcaatgccattaaaaacggtgttttgacgatcaatggcgagcgggtgccgattgatggccggatggcattctcgt
acacgtttgcgccggccagccatcaaaaagaagtgttgatccatatcgaaccatcggccgaaagcaaaacagccattttcaacaacgacggcg

FIGURE 16GG gagcgattgcgaaaaacacaaaagattacgtgctgaatttagaaacgaagcaattcaaaaagcttctcgagagtacttctagagcggccgcgg
gcccatcgattttccacccgggtggggtaccaggta SEQ ID NO: 90
Met Lys Glu Ala Val Val Tyr Gln Ile Phe Pro Asp Arg Phe Phe Asn Gly Asn Pro Ser Asn Asp Asn
Ser Lys Gln Gln Ala Arg Gly Ala Gln Pro Ile Glu His Arg Asp Trp Ser Asp Leu Pro Asp Asn Pro
Arg Leu Lys Gly Thr Ser Gly Tyr Asp Gly Asp Gly Glu Trp Ser Asn Asp Phe Phe Gly Gly Asp Ile
Ala Gly Ile Glu Gln Lys Leu Asp Tyr Leu Gln Ser Leu Gly Val Asn Thr Ile Tyr Leu Asn Pro Ile
Ala Asn Ala Pro Ser Asn His Lys Tyr Asp Ala Ser Asn Tyr Lys Glu Leu Asp Pro Met Phe Gly Ser
Pro Glu Glu Phe Gln Ser Phe Val Gln Ala Leu Ala Asn Arg Gly Met His Leu Ile Leu Asp Gly Val
Phe Asn His Val Ser Asp Asp Ser Ile Tyr Phe Asp Arg Tyr His Arg Tyr Pro Thr Val Gly Ala Tyr
Glu Tyr Trp Glu Ala Val Tyr Asp Leu Met Asn Glu Lys Gly Leu Ser Glu Glu Ala Arg Lys Gln
Val Glu Glu Lys Phe Lys Gln Glu Gly Gln Thr Phe Ser Pro Tyr Gly Phe His Leu Trp Phe Asn Ile
Glu Asn Lys Lys Val Asn Gly His Tyr Gln Tyr Gln Ser Trp Trp Gly Tyr Asp Ser Leu Pro Glu Phe
Lys Ser Val Thr Gly Glu Lys Val Pro His Pro Ser Glu Leu Asn Asn Asp Ala Leu Ala Asn Tyr Ile
Phe Arg Glu Ser Asp Ser Val Ala Lys Ser Trp Ile Ala Leu Gly Ala Ser Gly Trp Arg Leu Asp Val
Ala Asn Glu Val Asp Pro Ala Phe Trp Arg Glu Phe Arg Gln Glu Leu Leu Gln Gly Ser Tyr Gly Arg
Gly Pro Thr Leu Lys Glu Gly Glu Gln Pro Leu Ile Leu Gly Glu Ile Trp Asp Asp Ala Ser Lys Tyr
Phe Leu Gly Asp Gln Tyr Asp Ser Val Met Asn Tyr Arg Phe Arg Gly Ala Val Leu Asp Phe Leu
Lys Asn Gly Asn Ala Glu Glu Ala Asp Lys Arg Leu Thr Ala Ile Arg Glu Asp Tyr Pro Ser Glu Ala
Phe Tyr Ala Leu Met Asn Leu Ile Gly Ser His Asp Thr Ala Arg Ala Val Phe Leu Leu Gly Asn Gly
Thr Asp Ser Ser Glu Arg Ala Glu Leu Asp Pro Asn Tyr Asn Glu Glu Leu Gly Lys Lys Arg Leu
Lys Leu Ala Val Ile Leu Gln Met Gly Tyr Pro Gly Ala Pro Thr Ile Tyr Tyr Gly Asp Glu Ala Gly
Val Thr Gly Ser Lys Asp Pro Asp Asn Arg Arg Thr Tyr Pro Trp Gly Lys Glu Asp Gln Asn Leu
Leu Ser His Tyr Gln Lys Val Gly His Ile Arg Gln His His Gln Ser Leu Leu Ala His Gly Asp Ile
Lys Thr Val Tyr Ala Gln Gly Asp Val Tyr Val Phe Ala Arg Gln Tyr Gly Arg Glu Ala Ala Leu Ile
Ala Ile Asn Arg Gly Asn Glu Asp Lys Thr Val Ala Leu Asp Val Ala Ser Leu Leu Pro Asn Gly Thr
Val Leu Thr Asp Glu Leu His Asp Gly Gly Glu Ala Thr Val Ala Gly Gly Thr Leu Thr Val Thr Ile
Pro Ala Leu Asp Gly Arg Met Met Phe Gly Thr Val Thr Ala Glu Met Pro Ala Ala Val Ser Asn Leu
Gln Ala Ser Ala Ser Asp Gly Cys Val Thr Leu Thr Trp Glu Gly Asn Ala Ser Arg Tyr Arg Ile Tyr
Glu Ser Thr Leu Lys Gly Ala Gly Tyr Thr Met Val Gln Glu Thr Glu Thr Thr Ser Ala Thr Ile Gly
Ser Leu Thr Asn Gly Thr Ala Tyr Tyr Phe Ala Val Ala Ala Val Asp Glu Asn Gly Asn Glu Ser Pro
Lys Val Glu Thr Asn Arg Val Val Pro His Tyr Pro Leu Thr Ser Asp Asn Val Gln Phe Val Thr Thr
Leu Ser Asp Ala Thr Leu Asp Leu Ser Lys Pro Gln Gln Val Asp Val His Val Asn Ile Asp Asn Val
Thr Ser Lys Gly Ala Ala Asp Gly Leu Gln Ala Val Leu Gln Val Lys Gly Pro His Asp Glu Thr Trp
Lys Glu Tyr Arg Ala Ala Tyr Gln Gly Gln Asp Gly Asp Ala Asn Val Phe Arg Ala Ala Phe Thr Pro
Leu Ala Ala Gly Thr Tyr Thr Tyr Arg Tyr Ala Leu Thr Thr Asn Leu Gly Glu Glu Trp Met Tyr Thr
Glu Glu Lys Gln Val Thr Phe Ala Ala Asp Asn Ser Asp Gln Ile Ala Pro Ala Asp Ala Ile Glu Leu
Arg Gln Pro Ala Val Glu Ser Gly Gln Val Asn Leu Ser Trp Thr Phe Val Gly Lys Lys Asp Gly Asp
Ala Tyr Leu Leu Ala Ile Glu Arg Asn Gly Asp Ile Val His Thr Thr Thr Ser Ile Gly Asp Ser Phe Thr
Asp Tyr Asp Val Glu Asn Gly Thr Glu Tyr Thr Tyr Val Val Lys Leu Tyr Asp Arg Ala Gly Asn
Val Val Ala Ser Asn Thr Val Lys Val Thr Pro Asp Ile Val Met Val Lys Val Ile Phe Lys Val Arg
Ala Pro Asp Tyr Thr Pro Leu Asp Ala Arg Ile Thr Ile Pro Asn Ser Leu Asn Gly Trp Asn Thr Gly
Ala Trp Glu Met Ser Arg Asn Gly Ala Val Thr Pro Asp Trp Gln Phe Thr Val Glu Val Gln Glu Gly
Glu Thr Ile Thr Tyr Lys Tyr Val Lys Gly Gly Ser Trp Asp Gln Glu Gly Leu Ala Asp His Thr Arg
Glu Asp Asp Asn Asp Asp Asp Val Ser Tyr Tyr Gly Tyr Gly Thr Ile Gly Thr Asp Leu Lys Val Thr
Val His Asn Glu Gly Asn Asn Thr Met Ile Val Gln Asp Arg Ile Leu Arg Trp Ile Asp Met Pro Val
Val Ile Glu Glu Val Gln Lys Gln Gly Ser Gln Val Thr Ile Lys Gly Asn Ala Ile Lys Asn Gly Val
Leu Thr Ile Asn Gly Glu Arg Val Pro Ile Asp Gly Arg Met Ala Phe Ser Tyr Thr Phe Ala Pro Ala
Ser His Gln Lys Glu Val Leu Ile His Ile Glu Pro Ser Ala Glu Ser Lys Thr Ala Ile Phe Asn Asn Asp

FIGURE 16HH

Gly Gly Ala Ile Ala Lys Asn Thr Lys Asp Tyr Val Leu Asn Leu Glu Thr Lys Gln Phe Lys Lys Leu Leu Glu Ser Thr Ser Arg Ala Ala Ala Gly Pro Ser Ile Phe His Pro Gly Gly Val Pro Gly

SEQ ID NO: 91
gtgctaacgtttcaccgcatcattcgaaaaggatggatgttcctgctcgcgttttgctcactgcctcgctgttctgcccaacaggacagcccgcca
aggctgccgcaccgtttaacggcaccatgatgcagtattttgaatggtacttgccggatgatggcacgttatggaccaaagtggccaatgaagc
caacaacttatccagccttggcatcaccgctctttggctgccgcccgcttataaaggaacaagccgcagcgacgtagggtacggagtatacga
cttgtatgacctcggcgaattcaatcaaaaagggaccgtccgcacaaaatacggaacaaaagctcaatatcttcaagccattcaagccgccac
gccgctggaatgcaagtgtacgccgatgtcgtgttcgaccataaaggcggcgccgacggcacggaatgggtggacgccgtcgaagtcaatc
cgtccgaccgcaaccaagaaatctcgggcacctatcaaatccaagcatggacgaaatttgattttcccgggcggggcaacacctactccagctt
taagtggcgctggtaccattttgacggcgttgattgggacgaaagccgaaaattgagccgcatttacaaattccgcggcatcggcaaagcgtgg
gattgggaagtagacacggaaaacggaaactatgactacttaatgtatgccgacttggacatggaccatcctgaagtggttacggaactgaaaa
actggggcaaatggtatgtcaacacaacgaacattgatgggttccggcttgatgccgtcaagcatattaagttcagtttttttcctgattggttgtcgt
atgtgcgttctcagactggcaagccgctatttaccgtcggggaatattggagctatgacatcaacaagttgcacaattacattacgaaaacaaacg
gaacgatgtctttgtttgatgccccgttacacaacaaattttataccgcttccaaatcagggggcgcatttgatatgcgcacgttaatgaccaatact
ctcatgaaagatcaaccgacattggccgtcaccttcgttgataatcatgacaccgaacccggccaagcgctgcagtcatgggtcgacccatggt
tcaaaccgttggcttacgcctttattctaactcggcaggaaggataccgtgcgtcttttatggtgactattatggcatcccacaatataacattccct
cgctgaaaagcaaaatcgatccgctcctcatcgcgcgcagggattatgcttacggaacgcaacatgattatcttgatcactccgacatcatcggg
tggacaagggaaggcgtcactgaaaaaccaggatccggactggccgcactgatcaccgatgggccgggaggaagcaaatggatgtacgtt
ggcaaacaacacgccggaaaagtgttctatgaccttaccggcaaccggagtgacaccgtcaccatcaacagtgatggatggggagaattcaa
agtcaatggcggttcggtttcggtttgggttcctagaaaaacgaccgtctctaccatcgcttggccgatcacaacccgaccgtggactggtgaatt
cgtccgttggaccgaaccacggttggtggcatggccttga SEQ ID NO: 92
Val Leu Thr Phe His Arg Ile Ile Arg Lys Gly Trp Met Phe Leu Leu Ala Phe Leu Leu Thr Ala Ser Leu Phe Cys Pro Thr Gly Gln Pro Ala Lys Ala Ala Ala Pro Phe Asn Gly Thr Met Met Gln Tyr Phe Glu Trp Tyr Leu Pro Asp Asp Gly Thr Leu Trp Thr Lys Val Ala Asn Glu Ala Asn Asn Leu Ser Ser Leu Gly Ile Thr Ala Leu Trp Leu Pro Pro Ala Tyr Lys Gly Thr Ser Arg Ser Asp Val Gly Tyr Gly Val Tyr Asp Leu Tyr Asp Leu Gly Glu Phe Asn Gln Lys Gly Thr Val Arg Thr Lys Tyr Gly Thr Lys Ala Gln Tyr Leu Gln Ala Ile Gln Ala Ala His Ala Ala Gly Met Gln Val Tyr Ala Asp Val Val Phe Asp His Lys Gly Gly Ala Asp Gly Thr Glu Trp Val Asp Ala Val Glu Val Asn Pro Ser Asp Arg Asn Gln Glu Ile Ser Gly Thr Tyr Gln Ile Gln Ala Trp Thr Lys Phe Asp Phe Pro Gly Arg Gly Asn Thr Tyr Ser Ser Phe Lys Trp Arg Trp Tyr His Phe Asp Gly Val Asp Trp Asp Glu Ser Arg Lys Leu Ser Arg Ile Tyr Lys Phe Arg Gly Ile Gly Lys Ala Trp Asp Trp Glu Val Asp Thr Glu Asn Gly Asn Tyr Asp Tyr Leu Met Tyr Ala Asp Leu Asp Met Asp His Pro Glu Val Val Thr Glu Leu Lys Asn Trp Gly Lys Trp Tyr Val Asn Thr Thr Asn Ile Asp Gly Phe Arg Leu Asp Ala Val Lys His Ile Lys Phe Ser Phe Phe Pro Asp Trp Leu Ser Tyr Val Arg Ser Gln Thr Gly Lys Pro Leu Phe Thr Val Gly Glu Tyr Trp Ser Tyr Asp Ile Asn Lys Leu His Asn Tyr Ile Thr Lys Thr Asn Gly Thr Met Ser Leu Phe Asp Ala Pro Leu His Asn Lys Phe Tyr Thr Ala Ser Lys Ser Gly Gly Ala Phe Asp Met Arg Thr Leu Met Thr Asn Thr Leu Met Lys Asp Gln Pro Thr Leu Ala Val Thr Phe Val Asp Asn His Asp Thr Glu Pro Gly Gln Ala Leu Gln Ser Trp Val Asp Pro Trp Phe Lys Pro Leu Ala Tyr Ala Phe Ile Leu Thr Arg Gln Glu Gly Tyr Pro Cys Val Phe Tyr Gly Asp Tyr Tyr Gly Ile Pro Gln Tyr Asn Ile Pro Ser Leu Lys Ser Lys Ile Asp Pro Leu Leu Ile Ala Arg Arg Asp Tyr Ala Tyr Gly Thr Gln His Asp Tyr Leu Asp His Ser Asp Ile Ile Gly Trp Thr Arg Glu Gly Val Thr Glu Lys Pro Gly Ser Gly Leu Ala Ala Leu Ile Thr Asp Gly Pro Gly Gly Ser Lys Trp Met Tyr Val Gly Lys Gln His Ala Gly Lys Val Phe Tyr Asp Leu Thr Gly Asn Arg Ser Asp Thr Val Thr Ile Asn Ser Asp Gly Trp Gly Glu Phe Lys Val Asn Gly Gly Ser Val Ser Val Trp Val Pro Arg Lys Thr Thr Val Ser Thr Ile Ala Trp Pro Ile Thr Thr Arg Pro Trp Thr Gly Glu Phe Val Arg Trp Thr Glu Pro Arg Leu Val Ala Trp Pro

FIGURE 16II

SEQ ID NO: 93
atgaaatcgtttgcattcatgcctatcctttttatgcaaacgatttcatcagtgaaagggaaggaggaggaaaaatggggaagaatatgagaaga
agattcacgtattttcaatcttcttattgttcgttcagctgttttcatttagtgcaaccgctagcgccaatggaacggtgaacagtagtcctgtggttaa
tggaaacgaagtcacgtttctatatggaggaacaggaaacgagcagtctgtgttactggcaggctcctttaatgattggcagaaagatggtgaca
agaagattgcactaacaaaaggcgacaataacgtctggtctgtcacgcaaacacttcaagatgggacatatacgtataagtttgttgtagatggtc
aatgggtggcggatccgcttaacccgaatcaagtagacgacggttacggcggccgtaatagtgtcgttgttgtcgggacaccggtgcaacaag
aacggacagtgacgcttgttggtaacttacaagacgaattaggtcatacgagcgaatgggatccgaaagcgacagctacagtgatgaaaaagg
aagggaacgggttatatacgtttacaggtacacttccagccggaacgtacgagtataaaattgcgattaatggcagctgggacgaaaactatggt
gtcggcggccgcgatggcgggaatattaagctgctattaaatgaacaaacaacggttacattttattacaacgacagaacgcatgcgattgcgg
attcgacttggtatgcaccaattctaaaagaaaagcagccgcggctcgttggaacgattttaccagctattggttatgaaacagacgtgaacggtt
ggacgccgcaaacatcaacggcgttgttgtcagatgatgattttgattccatttatacgtttaaggcgcgtgtgccaaaagggacatatgaatataa
agtagttcttgggaatgattggacatatgaaaattatccacaagataatgccaaattaaatgtgcttgaagaaacgacaattacctttttctttaacgc
gaaaacgaaagtagtgtataccgattacaatccaagcggttcggatggtatcgtccaaaaagaccgtttgaagcataatacgtgggattcgttgta
tcgccaaccgtttggtgcggtgaaagctgggacagaagtgacccttcgtttatcagcgaaaaaaggtgatttgacaaaagcggatgtatatgtaa
aaaatacgacaaccggcacagcgaaactatattcgatgaaaaaagccggtgttcttggcgaagaagaatattgggaagcgacattcacaccgg
atgtgaaaggagtatacggttataaatttattgcggtagatgctggaacgaaagcagaatacggggaagatacacaagaagggcagtgggga
aaagcagtagataaaaatgcagagctgttccaattaacggtgtacgacccatcctaccaaacaccggattggatgaaagaagcagttgtatatca
aatttccctgatccaaag SEQ ID NO: 94
Met Lys Ser Phe Ala Phe Met Pro Ile Leu Phe Tyr Ala Asn Asp Phe Ile Ser Glu Arg Glu Gly Gly
Gly Lys Met Gly Lys Asn Met Arg Arg Arg Phe Thr Tyr Phe Ser Ile Phe Leu Leu Phe Val Gln Leu
Phe Ser Phe Ser Ala Thr Ala Ser Ala Asn Gly Thr Val Asn Ser Ser Pro Val Val Asn Gly Asn Glu
Val Thr Phe Leu Tyr Gly Gly Thr Gly Asn Glu Gln Ser Val Leu Leu Ala Gly Ser Phe Asn Asp Trp
Gln Lys Asp Gly Asp Lys Lys Ile Ala Leu Thr Lys Gly Asp Asn Asn Val Trp Ser Val Thr Gln Thr
Leu Gln Asp Gly Thr Tyr Thr Tyr Lys Phe Val Val Asp Gly Gln Trp Val Ala Asp Pro Leu Asn Pro
Asn Gln Val Asp Asp Gly Tyr Gly Gly Arg Asn Ser Val Val Val Val Gly Thr Pro Val Gln Gln Glu
Arg Thr Val Thr Leu Val Gly Asn Leu Gln Asp Glu Leu Gly His Thr Ser Glu Trp Asp Pro Lys Ala
Thr Ala Thr Val Met Lys Lys Glu Gly Asn Gly Leu Tyr Thr Phe Thr Gly Thr Leu Pro Ala Gly Thr
Tyr Glu Tyr Lys Ile Ala Ile Asn Gly Ser Trp Asp Glu Asn Tyr Gly Val Gly Gly Arg Asp Gly Gly
Asn Ile Lys Leu Leu Leu Asn Glu Gln Thr Thr Val Thr Phe Tyr Tyr Asn Asp Arg Thr His Ala Ile
Ala Asp Ser Thr Trp Tyr Ala Pro Ile Leu Lys Glu Lys Gln Pro Arg Leu Val Gly Thr Ile Leu Pro
Ala Ile Gly Tyr Glu Thr Asp Val Asn Gly Trp Thr Pro Gln Thr Ser Thr Ala Leu Leu Ser Asp Asp
Asp Phe Asp Ser Ile Tyr Thr Phe Lys Ala Arg Val Pro Lys Gly Thr Tyr Glu Tyr Lys Val Val Leu
Gly Asn Asp Trp Thr Tyr Glu Asn Tyr Pro Gln Asp Asn Ala Lys Leu Asn Val Leu Glu Glu Thr
Thr Ile Thr Phe Phe Phe Asn Ala Lys Thr Lys Val Val Tyr Thr Asp Tyr Asn Pro Ser Gly Ser Asp
Gly Ile Val Gln Lys Asp Arg Leu Lys His Asn Thr Trp Asp Ser Leu Tyr Arg Gln Pro Phe Gly Ala
Val Lys Ala Gly Thr Glu Val Thr Leu Arg Leu Ser Ala Lys Lys Gly Asp Leu Thr Lys Ala Asp Val
Tyr Val Lys Asn Thr Thr Thr Gly Thr Ala Lys Leu Tyr Ser Met Lys Lys Ala Gly Val Leu Gly Glu
Glu Glu Tyr Trp Glu Ala Thr Phe Thr Pro Asp Val Lys Gly Val Tyr Gly Tyr Lys Phe Ile Ala Val
Asp Ala Gly Thr Lys Ala Glu Tyr Gly Glu Asp Thr Gln Glu Gly Gln Trp Gly Lys Ala Val Asp Lys
Asn Ala Glu Leu Phe Gln Leu Thr Val Tyr Asp Pro Ser Tyr Gln Thr Pro Asp Trp Met Lys Glu Ala
Val Val Tyr Gln Ile Phe Pro Asp Pro Lys SEQ ID NO: 95
atgtatacactattcatccgttcatattttgatactgatggtgatggtgtaggagacttagtggagttgctgaaaaggtagattatctaaaatctcttg
gagtagatacagtctggttttaccatttaataaaagtaaatcttatcatggatatgatgttgaagattactatgatgtagaaccagattatggaacact
acaagatcttgataatatgataaaagttctaaatgaaaatggaataaaggtagtaatggatcttgttgttaatcatacgtcggatacacatccatggtt
tcttgatgcagttgaaaatactactaattctccatattggaactattacattatgagcttggatgagcctcaaaataagaatcattggcattataaggtt
aattcaaaaggacaaactgtgtggtatttggattgtttgattcatcaatgccggaccttaattacgacaaccctaagtaatggatgaagtgaaaa

FIGURE 16JJ aataatagattttttgggcagatatgggagtagatggatttagattagatgcagcaaaacattattatggatttgactggagcgatggaattgaacag
tcagcaagcgttgcaaaagagatagaagactatataaaagataaactaggggaaaatgcaatagttgtgagtgaggtttacgatggagattcaa
atgttcttttaaaatttgctccaatgcctgtgtttaattttagttttatgtacaatttgagaggaaattttgaagggagagataacttaatttcagactctatt
agttgggttgattcctcgttgtataatttaaatgttttttcattttccatttattgatagtcatgatcttgacagatttatttctgagcttgtagatagtaaatatc
agggagatgtaatatctgccacaaaacaatatttgctagttaatgctttactactctcattaacaggcatgccaactatttactatggtgatgaaatag
gacttaggggatggaagtggcattcagaaccatgggatatacctgtgcgtgagccaatgcaatggtataaggatcaaaaagggaacggtcaaa
cttattggacaaaagagttttacgaaggtattactgaaggaagtgctaatgaagatggagcaatatacgatgatccagatgatggagtatctgtag
aagaacaagaaaatggatattctattttttaaacttttttaaagaatttatcaacttacgaaaagattatccggcacttgcttttggaagtactacgattga
gagagattggaaaaacttgtatgttttgaaaaagtcgtataacttccaggatgttcttgtattaattaaccttgatccaacgtattcaaatacatacgaa
gttccagaagggtataaatgggtgtggtatgcattttttgatggtgacaactatgaatttggagcaaaagatgaaatgattttacagaatacaagttg
gacgataaatccaaggcaaatttatatatttgtaaagtaa SEQ ID NO: 96
Met Tyr Thr Leu Phe Ile Arg Ser Tyr Phe Asp Thr Asp Gly Asp Gly Val Gly Asp Phe Ser Gly Val
Ala Glu Lys Val Asp Tyr Leu Lys Ser Leu Gly Val Asp Thr Val Trp Phe Leu Pro Phe Asn Lys Ser
Lys Ser Tyr His Gly Tyr Asp Val Glu Asp Tyr Tyr Asp Val Glu Pro Asp Tyr Gly Thr Leu Gln Asp
Leu Asp Asn Met Ile Lys Val Leu Asn Glu Asn Gly Ile Lys Val Val Met Asp Leu Val Val Asn His
Thr Ser Asp Thr His Pro Trp Phe Leu Asp Ala Val Glu Asn Thr Thr Asn Ser Pro Tyr Trp Asn Tyr
Tyr Ile Met Ser Leu Asp Glu Pro Gln Asn Lys Asn His Trp His Tyr Lys Val Asn Ser Lys Gly Gln
Thr Val Trp Tyr Phe Gly Leu Phe Asp Ser Ser Met Pro Asp Leu Asn Tyr Asp Asn Pro Lys Val Met
Asp Glu Val Lys Lys Ile Ile Asp Phe Trp Ala Asp Met Gly Val Asp Gly Phe Arg Leu Asp Ala Ala
Lys His Tyr Tyr Gly Phe Asp Trp Ser Asp Gly Ile Glu Gln Ser Ala Ser Val Ala Lys Glu Ile Glu
Asp Tyr Ile Lys Asp Lys Leu Gly Glu Asn Ala Ile Val Val.Ser Glu Val Tyr Asp Gly Asp Ser Asn
Val Leu Leu Lys Phe Ala Pro Met Pro Val Phe Asn Phe Ser Met Tyr Asn Leu Arg Gly Asn
Phe Glu Gly Arg Asp Asn Leu Ile Ser Asp Ser Ile Ser Trp Val Asp Ser Ser Leu Tyr Asn Leu Asn
Val Phe His Phe Pro Phe Ile Asp Ser His Asp Leu Asp Arg Phe Ile Ser Glu Leu Val Asp Ser Lys
Tyr Gln Gly Asp Val Ile Ser Ala Thr Lys Gln Tyr Leu Leu Val Asn Ala Leu Leu Leu Ser Leu Thr
Gly Met Pro Thr Ile Tyr Tyr Gly Asp Glu Ile Gly Leu Arg Gly Trp Lys Trp His Ser Glu Pro Trp
Asp Ile Pro Val Arg Glu Pro Met Gln Trp Tyr Lys Asp Gln Lys Gly Asn Gly Gln Thr Tyr Trp Thr
Lys Glu Phe Tyr Glu Gly Ile Thr Glu Gly Ser Ala Asn Glu Asp Gly Ala Ile Tyr Asp Asp Pro Asp
Asp Gly Val Ser Val Glu Glu Gln Glu Asn Gly Tyr Ser Ile Leu Asn Phe Phe Lys Glu Phe Ile Asn
Leu Arg Lys Asp Tyr Pro Ala Leu Ala Phe Gly Ser Thr Thr Ile Glu Arg Asp Trp Lys Asn Leu Tyr
Val Leu Lys Lys Ser Tyr Asn Phe Gln Asp Val Leu Val Leu Ile Asn Leu Asp Pro Thr Tyr Ser Asn
Thr Tyr Glu Val Pro Glu Gly Tyr Lys Trp Val Trp Tyr Ala Phe Phe Asp Gly Asp Asn Tyr Glu Phe
Gly Ala Lys Asp Glu Met Ile Leu Gln Asn Thr Ser Trp Thr Ile Asn Pro Arg Gln Ile Tyr Ile Phe Val
Lys SEQ ID NO: 97
atgaggaagaagatgtcgcattcaagatttactttctttgatcttagcacttttattttcttctccggttgtatttcagaagttaaaagcgaaagccag
ctactaaattcaaagcaaaaggtccttgtaaaagtaaatgttaatacgccatttattgagaatgctactactaatacgtggagtgtttcaaaagaatct
tttattgattatcttagtaaagtgattattactgttaaggatgtaaatgatcagattgtatttactaaggaaacaacgaacaaaacaaatattalttttgaa
attgaacttcttcctggaacttatacatttgaggtaaaaggatatgaggaagatttagttatattttcagggaaaaagttaatcagatcatagatgag
aaaaataatattgttaatgtcgaaactttttttgttaatggaatagttaggacaataattgaagttgacgatattattataaaaattatgatattacatcgg
caacgttgatcttcaaaaaagatacagcacaagaagattatgaagaggtacctgtaacacttacaggtacttccacttaattaataaagaattatat
cctggtatgtggactgtaaaatttgaagttgatcttaaatcaaaggatgcaagtatgttaccagaaaagttcatcttgaaaatgaatttagcataga
agtgcttccagcaaagacaaaaagttaacatttaatgtagtctttgatacagaggttaatgaaccgaaattagtagttgtatttccgcaaattgagtt
gccttttgtggatcctgtaacaaatttaagtggagagataaatgaattagaaggaaatctttcaatgaattgggactattcagatccaaatgcagaat
ttatgtgtataaagaattagaggaacaaggagaatatttgtatgaatttgttggaaaaacacgcgagaaaagttatacaatagaaaatttttaccaag
caagaattcgataaatttagtggaatcgctattaatgtttatgccaacggtaaagagagtggattagttgttctaaaaaagaaaatattaaacttata
gattlagaaagtgttgacagtataagtgctactataacgttgatacgaatgagcttaagttggattggaattataccaattcaagtgtacttttgaag

FIGURE 16KK ttttgaaaaaaggtataaatagcaatgaatacgaaataatttctcaactaacacaaaattcttttttcaacagaattcacaggcaggcaattttgggatc
ttgagaaaattgcgattagagtagttgctaatggatttgaaagtaagattaatgagatttcaagagatgatataactataacatcattgaatcttcctct
tacatcgtctactatgtatacactattcatccgttcatattttgatactgatggtgatggtgtaggagactttagtggagttgctgaaaaggtagattatc
taaaatctcttggagtagatacagtctggtttttaccatttaataaaagtaaatcttatcatggatatgatgttgaagattactatgatgtagaaccagat
tatggaacactacaagatcttgataatatgataaaagttctaaatgaaaatggaataaaggtagtaatggatcttgttgttaatcatacgtcggatac
acatccatggtttcttgatgcagttgaaaatactactaattctccatattggaactattacattatgagcttggatgagcctcaaaataagaatcattgg
cattataaggttaattcaaaaggacaaactgtgtggtattttggattgtttgattcatcaatgccggaccttaattacgacaaccctaaagtaatggat
gaagtgaaaaaaataatagatttttgggcagatatgggagtagatggatttagattagatgcagcaaaacattattatggatttgactggagcgatg
gaattgaacagtcagcaagcgttgcaaaagagatagaagactatataaaagataaactagggggaaaatgcaatagttgtgagtgaggtttacga
tggagattcaaatgttcttttaaaatttgctccaatgcctgtgtttaattttagttttatgtacaatttgagaggaaaattttgaagggagagataacttaatt
tcagactctattagttgggttgattcctcgttgtataatttaaatgtttttcattttccatttattgatagtcatgatcttgacagatttatttctgagcttgtag
atagtaaatatcagggagatgtaatatctgccacaaaacaatatttgctagttaatgctttactactctcattaacaggcatgccaactatttactatgg
tgatgaaataggacttaggggatggaagtggcattcagaaccatgggatatacctgtgcgtgagccaatgcaatggtataaggatcaaaaagg
gaacggtcaaacttattggacaaaagagtttttacgaaggtattactgaaggaagtgctaatgaagatggagcaatatacgatgatccagatgatg
gagtatctgtagaagaacaagaaaatggatattctattttaaactttttaaagaatttatcaacttacgaaaagattatccggcacttgcttttggaagt
actacgattgagagagattggaaaaacttgtatgttttgaaaaagtcgtataacttccaggatgttcttgtattaattaaccttgatccaacgtattcaa
atacatacgaagttccagaagggtataaatgggtgtggtatgcatttttttgatggtgacaactatgaatttggagcaaaagatgaaatgattttacag
aatacaagttggacgataaatccaaggcaaatttatatatttgtaaagtaa SEQ ID NO: 98
Met Arg Lys Lys Met Ser His Ser Arg Phe Thr Phe Leu Leu Ile Leu Ala Leu Phe Ile Phe Phe Ser
Gly Cys Ile Ser Glu Val Lys Ser Glu Ser Gln Leu Leu Asn Ser Lys Gln Lys Val Leu Val Lys Val
Asn Val Asn Thr Pro Phe Ile Glu Asn Ala Thr Thr Asn Thr Trp Ser Val Ser Lys Glu Ser Phe Ile
Asp Tyr Leu Ser Lys Val Ile Ile Thr Val Lys Asp Val Asn Asp Gln Ile Val Phe Thr Lys Glu Thr
Thr Asn Lys Thr Asn Ile Tyr Phe Glu Ile Glu Leu Leu Pro Gly Thr Tyr Thr Phe Glu Val Lys Gly
Tyr Glu Glu Asp Leu Val Ile Phe Ser Gly Glu Lys Val Asn Gln Ile Ile Asp Glu Lys Asn Asn Ile
Val Asn Val Glu Thr Phe Phe Val Asn Gly Ile Val Arg Thr Ile Ile Glu Val Asp Asp Ile Ile Tyr Lys
Asn Tyr Asp Ile Thr Ser Ala Thr Leu Ile Phe Lys Lys Asp Thr Ala Gln Glu Asp Tyr Glu Glu Val
Pro Val Thr Leu Thr Gly Thr Ser Thr Leu Ile Asn Lys Glu Leu Tyr Pro Gly Met Trp Thr Val Lys
Phe Glu Val Asp Leu Lys Ser Lys Asp Ala Ser Met Leu Pro Glu Lys Val His Leu Glu Asn Glu Phe
Ser Ile Glu Val Leu Pro Ala Lys Thr Lys Ser Leu Thr Phe Asn Val Val Phe Asp Thr Glu Val Asn
Glu Pro Lys Leu Val Val Val Phe Pro Gln Ile Glu Leu Pro Phe Val Asp Pro Val Thr Asn Leu Ser
Gly Glu Ile Asn Glu Leu Glu Gly Asn Leu Ser Met Asn Trp Asp Tyr Ser Asp Pro Asn Ala Glu Phe
Tyr Val Tyr Lys Glu Leu Glu Glu Gln Gly Glu Tyr Leu Tyr Glu Phe Val Gly Lys Thr Arg Glu Lys
Ser Tyr Thr Ile Glu Asn Phe Thr Lys Gln Glu Phe Asp Lys Phe Ser Gly Ile Ala Ile Asn Val Tyr
Ala Asn Gly Lys Glu Ser Gly Leu Val Val Leu Lys Lys Glu Asn Ile Lys Leu Ile Asp Leu Glu Ser
Val Asp Ser Ile Ser Ala Thr Tyr Asn Val Asp Thr Asn Glu Leu Lys Leu Asp Trp Asn Tyr Thr Asn
Ser Ser Val Thr Phe Glu Val Leu Lys Lys Gly Ile Asn Ser Asn Glu Tyr Glu Ile Ile Ser Gln Leu Thr
Gln Asn Ser Phe Ser Thr Glu Phe Thr Gly Arg Gln Phe Trp Asp Leu Glu Lys Ile Ala Ile Arg Val
Val Ala Asn Gly Phe Glu Ser Lys Ile Asn Glu Ile Ser Arg Asp Asp Ile Thr Ile Thr Ser Leu Asn Leu
Pro Leu Thr Ser Ser Thr Met Tyr Thr Leu Phe Ile Arg Ser Tyr Phe Asp Thr Asp Gly Asp Gly Val
Gly Asp Phe Ser Gly Val Ala Glu Lys Val Asp Tyr Leu Lys Ser Leu Gly Val Asp Thr Val Trp Phe
Leu Pro Phe Asn Lys Ser Lys Ser Tyr His Gly Tyr Asp Val Glu Asp Tyr Tyr Asp Val Glu Pro Asp
Tyr Gly Thr Leu Gln Asp Leu Asp Asn Met Ile Lys Val Leu Asn Glu Asn Gly Ile Lys Val Val Met
Asp Leu Val Val Asn His Thr Ser Asp Thr His Pro Trp Phe Leu Asp Ala Val Glu Asn Thr Thr Asn
Ser Pro Tyr Trp Asn Tyr Tyr Ile Met Ser Leu Asp Glu Pro Gln Asn Lys Asn His Trp His Tyr Lys
Val Asn Ser Lys Gly Gln Thr Val Trp Tyr Phe Gly Leu Phe Asp Ser Ser Met Pro Asp Leu Asn Tyr
Asp Asn Pro Lys Val Met Asp Glu Val Lys Lys Ile Ile Asp Phe Trp Ala Asp Met Gly Val Asp Gly
Phe Arg Leu Asp Ala Ala Lys His Tyr Tyr Gly Phe Asp Trp Ser Asp Gly Ile Glu Gln Ser Ala Ser
Val Ala Lys Glu Ile Glu Asp Tyr Ile Lys Asp Lys Leu Gly Glu Asn Ala Ile Val Val Ser Glu Val

FIGURE 16LL

Tyr Asp Gly Asp Ser Asn Val Leu Leu Lys Phe Ala Pro Met Pro Val Phe Asn Phe Ser Phe Met Tyr
Asn Leu Arg Gly Asn Phe Glu Gly Arg Asp Asn Leu Ile Ser Asp Ser Ile Ser Trp Val Asp Ser Ser
Leu Tyr Asn Leu Asn Val Phe His Phe Pro Phe Ile Asp Ser His Asp Leu Asp Arg Phe Ile Ser Glu
Leu Val Asp Ser Lys Tyr Gln Gly Asp Val Ile Ser Ala Thr Lys Gln Tyr Leu Leu Val Asn Ala Leu
Leu Leu Ser Leu Thr Gly Met Pro Thr Ile Tyr Tyr Gly Asp Glu Ile Gly Leu Arg Gly Trp Lys Trp
His Ser Glu Pro Trp Asp Ile Pro Val Arg Glu Pro Met Gln Trp Tyr Lys Asp Gln Lys Gly Asn Gly
Gln Thr Tyr Trp Thr Lys Glu Phe Tyr Glu Gly Ile Thr Glu Gly Ser Ala Asn Glu Asp Gly Ala Ile
Tyr Asp Asp Pro Asp Asp Gly Val Ser Val Glu Glu Gln Glu Asn Gly Tyr Ser Ile Leu Asn Phe Phe
Lys Glu Phe Ile Asn Leu Arg Lys Asp Tyr Pro Ala Leu Ala Phe Gly Ser Thr Thr Ile Glu Arg Asp
Trp Lys Asn Leu Tyr Val Leu Lys Lys Ser Tyr Asn Phe Gln Asp Val Leu Val Leu Ile Asn Leu Asp
Pro Thr Tyr Ser Asn Thr Tyr Glu Val Pro Glu Gly Tyr Lys Trp Val Trp Tyr Ala Phe Phe Asp Gly
Asp Asn Tyr Glu Phe Gly Ala Lys Asp Glu Met Ile Leu Gln Asn Thr Ser Trp Thr Ile Asn Pro Arg
Gln Ile Tyr Ile Phe Val Lys

SEQ ID NO: 99
atgtacacactcttcatccgctcttttttacgatacaaacaacgacggtgtaggtgactacaacggtgttgcccaaaaagtagactatctcaaaacg
cttggagtggatacagtttggttcttgccgttcaacaaagcaaaatcgtaccacggttacgatgttgaagactactacgatgtagaacctgactatg
gaacatacgcacaacttgaaaatatgataaagacactcaatcagaacggaattcgtgttgttatggacttggttgtgaaccacacttccgatacac
actcgtggtttctggatgccgttgagaacacaacgaattcgaaatattggagctactacataatgacacttgaaaatagagacggttggaatcact
ggcattggaagataaactcaaaagggcaaaaagtttactacttcggactgtttgactcatcaatgcccgattgaatttcgacaatccaagtgat
gaacgaaatcaagagaataatcgatttctggataacagttggtgtggatggtttcagacttgatgcaccaaagcactacaaaggctgggattggg
acgacggcatttcaggttcagcagcaatcgcgagggaaatagaaagttacatcaggagcaagttaggaaacgatgcgatagttgtcggggaa
gtgtacgatggaaatccatcggttctttcacaatttgcaccgatgccggcgttcaacttcacattcatgtatggaataacaggcaaccatgagggg
aaagataacctgctgggagaaacaatttcatgggttaatggagcgagttattatctcaacgtaaaacatttcccgttcatagacaatcacgatttga
acagatggatatcgatacttatcgaccaaaagtatagtggaaacacacaagttggtacgaagcagtatattttaacaaatgcgctcttgctttcctta
aacggtatgcctgttatttattatgggaatgaaatagggcttgagaggatggaaatggggacaagacccgtgggatttgccggtgagagagccga
tgcagtggtacgcaagtcaaagtggagctgggcagacatggtggacaaagcctgtctaccagcaaaaaggaatcacatttggaaatgcaaac
gtcgatggtgcgatgtacgatgatccaaatgatggggtttcagtagaagagcagatgaatggttacacgataaataacttctttaaacaattcataa
ccctgaggaagacatatccggctctatcgaaaggttcgataacgatagaacgcgactggaagaacctgtacgttatcaaacgagtctacggaa
atcaggaagtgcttgtattgataaacttagacccaacttggccgaacaattacacgttaccaggtggatacaggtgggtctggtatgcgttctttaa
tgggagtttgtttgaatttggcaataaaaacgaatcaccactgagccaagataccaactggacagtcaatccaaggcaagtgtatgtgtttgtgaa
ggactaa SEQ ID NO: 100
Met Tyr Thr Leu Phe Ile Arg Ser Phe Tyr Asp Thr Asn Asn Asp Gly Val Gly Asp Tyr Asn Gly Val
Ala Gln Lys Val Asp Tyr Leu Lys Thr Leu Gly Val Asp Thr Val Trp Phe Leu Pro Phe Asp Lys Ala
Lys Ser Tyr His Gly Tyr Asp Val Glu Asp Tyr Tyr Asp Val Glu Pro Asp Tyr Gly Thr Tyr Ala Gln
Leu Glu Asn Met Ile Lys Thr Leu Asn Gln Asn Gly Ile Arg Val Val Met Asp Leu Val Val Asn His
Thr Ser Asp Thr His Ser Trp Phe Leu Asp Ala Val Glu Asn Thr Asn Ser Lys Tyr Trp Ser Tyr
Tyr Ile Met Thr Leu Glu Asn Arg Asp Gly Trp Asn His Trp His Trp Lys Ile Asn Ser Lys Gly Gln
Lys Val Tyr Tyr Phe Gly Leu Phe Asp Ser Ser Met Pro Asp Leu Asn Phe Asp Asn Pro Gln Val
Met Asn Glu Ile Lys Arg Ile Ile Asp Phe Trp Ile Thr Val Gly Val Asp Gly Phe Arg Leu Asp Ala
Pro Lys His Tyr Lys Gly Trp Asp Trp Asp Gly Ile Ser Gly Ser Ala Ala Ile Ala Arg Glu Ile Glu
Ser Tyr Ile Arg Ser Lys Leu Gly Asn Asp Ala Ile Val Val Gly Glu Val Tyr Asp Gly Asn Pro Ser
Val Leu Ser Gln Phe Ala Pro Met Pro Ala Phe Asn Phe Thr Phe Met Tyr Gly Ile Thr Gly Asn His
Glu Gly Lys Asp Asn Leu Leu Gly Glu Thr Ile Ser Trp Val Asn Gly Ala Ser Tyr Tyr Leu Asn Val
Lys His Phe Pro Phe Ile Asp Asn His Asp Leu Asn Arg Trp Ile Ser Ile Leu Ile Asp Gln Lys Tyr Ser
Gly Asn Thr Gln Val Gly Thr Lys Gln Tyr Ile Leu Thr Asn Ala Leu Leu Leu Ser Leu Asn Gly Met
Pro Val Ile Tyr Tyr Gly Asn Glu Ile Gly Leu Arg Gly Trp Lys Trp Gly Gln Asp Pro Trp Asp Leu
Pro Val Arg Glu Pro Met Gln Trp Tyr Ala Ser Gln Ser Gly Ala Gly Gln Thr Trp Thr Lys Pro

FIGURE 16MM

Val Tyr Gln Gln Lys Gly Ile Thr Phe Gly Asn Ala Asn Val Asp Gly Ala Met Tyr Asp Asp Pro Asn Asp Gly Val Ser Val Glu Glu Gln Met Asn Gly Tyr Thr Ile Asn Asn Phe Phe Lys Gln Phe Ile Thr Leu Arg Lys Thr Tyr Pro Ala Leu Ser Lys Gly Ser Ile Thr Ile Glu Arg Asp Trp Lys Asn Leu Tyr Val Ile Lys Arg Val Tyr Gly Asn Gln Glu Val Leu Val Leu Ile Asn Leu Asp Pro Thr Trp Pro Asn Asn Tyr Thr Leu Pro Gly Gly Tyr Arg Trp Val Trp Tyr Ala Phe Phe Asn Gly Ser Leu Phe Glu Phe Gly Asn Lys Asn Glu Ser Pro Leu Ser Gln Asp Thr Asn Trp Thr Val Asn Pro Arg Gln Val Tyr Val Phe Val Lys Asp

SEQ ID NO: 101
ttgcgattctttccaaagttaatatcccctttccgcaaaacaccagagagtggcagcgaagcgcagtatcaagagacactgaacaattacaaag
gaaagtaataatgatcaatttgaaaaaaaacaccattagcgccctggtcgcaggtatggtattaggctttgcatccaacgcaatggcggttcctag
aaccgcttttgtacacctctttgaatggaaatgggaagatgttgcacaggagtgtgaaacatttctcggacctaaaggcttgccgcagtgcaagt
ctctccgccaactaaatctcacaacacggatgcatggtggggccgttatcaacccgttagttatgcttttgaaggacgcagcggtaatcgcagcc
aatttaaaaatatggtgcaacgttgtaaagctgtaggcgtcgatatatacgtagatgcagtgattaaccacatggcagcctacgacagaaatttcc
ctgatgtacccctatagcagtaatgactttaactcctgtacaggagatattgactataataaccgttggcaaacacagcattgtgatttagtcggtctta
atgatctaaaaacaggatctgactacgtccgccaaaaaatagcggattatatgaacgacgcaatcagtatgggtgtagctggtttccgtattgatg
cagccaaacatataccagcaggtgatatagctgccattaaaggtaaattaaatggtaatccatacatcttccaagaggtaattggtgcatccggcg
aacctgttcgaccgactgaatacacctttatcggtggtgtcacggaatttcaatttgctcgaaaattgggtccagccttccgcaatagtaatattgctt
ggttaaaagacattggcagtcaaatggaattatccagtgctgatgccgtaacatttgtaacgaatcatgatgaagagcgtcataacccgaatggtc
ctatttggcacggcgttcaaggtaatggttatgcattagcaaatattttcaccttagcttaccttacggctatccaaaaatcatgtcaggatacttctt
ccacggtgactttaacgcagctccaccaagcagtggtatacacacaggaaatgcgtgtggttttgatggcggagactgggtatgcgaacacaa
atggcgcggtattgctaacatggttgccttccgcaactatacagcaagcgaatggcgtatcagtaattggtggcaaaacagtaacgaccaaattg
cttttggtcgcggtggtttaggttttgttgttattaataaacgtgctaatggtagcattaatcaaagtttgatacgggaatgcctgatggccaatactgt
aacataatagaagctaactttgatgaaagcaccggccaatgtagtgcagctacagattccaacggtcaagccgttattaccgtcagtggtgggca
agctaactttaatgtagcaggcgatcatgctgctgcaattcatgttggcgcaaaaattggtgatcaatgtagtggtgatgattgcccatgtacagga
tccgattgtaataatgatcctaaacctgattttgcagtaccagcaacatcaatttgtacatcagaaaatttacctacgctatattactggggagcaca
gcctacagatagcttagcgaatgcagcttggccaggtgtcgcaatgcaaacaaatggcgactttaagtgtcatgatttaggtgtcgaactaacca
aaaattaacgccatctttagtgacaatggtgcaaataaaacagctgatctaactgttactggtgcaggttgttataaagacgggacttggagcacctt
acaaaattgtggctttgaaattaccggtgcacaaaccaatccagtcggtggcgacgaagtctggtacttccgaggtactgctaatgactggggta
aagcacaattagattatgacgcaactagcggtttgtattacacaatacaaagctttaatggtgaagaagcacctgcgcgttttaaaattgataatggt
agttggactgaagcttatccaacagctgattaccaagttacagataacaattcataccgcattaactttaatagcgatagcaaagcgattacagtaa
acgcacaataa SEQ ID NO: 102
Met Arg Phe Phe Pro Lys Leu Ile Ser Pro Phe Pro Gln Asn Thr Arg Glu Trp Gln Arg Ser Ala Val Ser Arg Asp Thr Glu Gln Leu Gln Arg Lys Val Ile Met Ile Asn Leu Lys Lys Asn Thr Ile Ser Ala Leu Val Ala Gly Met Val Leu Gly Phe Ala Ser Asn Ala Met Ala Val Pro Arg Thr Ala Phe Val His Leu Phe Glu Trp Lys Trp Glu Asp Val Ala Gln Glu Cys Glu Thr Phe Leu Gly Pro Lys Gly Phe Ala Ala Val Gln Val Ser Pro Pro Thr Lys Ser His Asn Thr Asp Ala Trp Trp Gly Arg Tyr Gln Pro Val Ser Tyr Ala Phe Glu Gly Arg Ser Gly Asn Arg Ser Gln Phe Lys Asn Met Val Gln Arg Cys Lys Ala Val Gly Val Asp Ile Tyr Val Asp Ala Val Ile Asn His Met Ala Ala Tyr Asp Arg Asn Phe Pro Asp Val Pro Tyr Ser Ser Asn Asp Phe Asn Ser Cys Thr Gly Asp Ile Asp Tyr Asn Asn Arg Trp Gln Thr Gln His Cys Asp Leu Val Gly Leu Asn Asp Leu Lys Thr Gly Ser Asp Tyr Val Arg Gln Lys Ile Ala Asp Tyr Met Asn Asp Ala Ile Ser Met Gly Val Ala Gly Phe Arg Ile Asp Ala Ala Lys His Ile Pro Ala Gly Asp Ile Ala Ala Ile Lys Gly Lys Leu Asn Gly Asn Pro Tyr Ile Phe Gln Glu Val Ile Gly Ala Ser Gly Glu Pro Val Arg Pro Thr Glu Tyr Thr Phe Ile Gly Gly Val Thr Glu Phe Gln Phe Ala Arg Lys Leu Gly Pro Ala Phe Arg Asn Ser Asn Ile Ala Trp Leu Lys Asp Ile Gly Ser Gln Met Glu Leu Ser Ser Ala Asp Ala Val Thr Phe Val Thr Asn His Asp Glu Glu Arg His Asn Pro Asn Gly Pro Ile Trp His Gly Val Gln Gly Asn Gly Tyr Ala Leu Ala Asn Ile Phe Thr Leu Ala Tyr Pro Tyr Gly Tyr Pro Lys Ile Met Ser Gly Tyr Phe Phe His Gly Asp Phe Asn Ala Ala Pro Pro Ser Ser Gly Ile His Thr

FIGURE 16NN

Gly Asn Ala Cys Gly Phe Asp Gly Gly Asp Trp Val Cys Glu His Lys Trp Arg Gly Ile Ala Asn Met
Val Ala Phe Arg Asn Tyr Thr Ala Ser Glu Trp Arg Ile Ser Asn Trp Trp Gln Asn Ser Asn Asp Gln
Ile Ala Phe Gly Arg Gly Gly Leu Gly Phe Val Val Ile Asn Lys Arg Ala Asn Gly Ser Ile Asn Gln
Ser Phe Asp Thr Gly Met Pro Asp Gly Gln Tyr Cys Asn Ile Ile Glu Ala Asn Phe Asp Glu Ser Thr
Gly Gln Cys Ser Ala Ala Thr Asp Ser Asn Gly Gln Ala Val Ile Thr Val Ser Gly Gly Gln Ala Asn
Phe Asn Val Ala Gly Asp His Ala Ala Ala Ile His Val Gly Ala Lys Ile Gly Asp Gln Cys Ser Gly
Asp Asp Cys Pro Cys Thr Gly Ser Asp Cys Asn Asn Asp Pro Lys Pro Asp Phe Ala Val Pro Ala
Thr Ser Ile Cys Thr Ser Glu Asn Leu Pro Thr Leu Tyr Tyr Trp Gly Ala Gln Pro Thr Asp Ser Leu
Ala Asn Ala Ala Trp Pro Gly Val Ala Met Gln Thr Asn Gly Asp Phe Lys Cys His Asp Leu Gly Val
Glu Leu Thr Lys Ile Asn Ala Ile Phe Ser Asp Asn Gly Ala Asn Lys Thr Ala Asp Leu Thr Val Thr
Gly Ala Gly Cys Tyr Lys Asp Gly Thr Trp Ser Thr Leu Gln Asn Cys Gly Phe Glu Ile Thr Gly Ala
Gln Thr Asn Pro Val Gly Gly Asp Glu Val Trp Tyr Phe Arg Gly Thr Ala Asn Asp Trp Gly Lys Ala
Gln Leu Asp Tyr Asp Ala Thr Ser Gly Leu Tyr Tyr Thr Ile Gln Ser Phe Asn Gly Glu Glu Ala Pro
Ala Arg Phe Lys Ile Asp Asn Gly Ser Trp Thr Glu Ala Tyr Pro Thr Ala Asp Tyr Gln Val Thr Asp
Asn Asn Ser Tyr Arg Ile Asn Phe Asn Ser Asp Ser Lys Ala Ile Thr Val Asn Ala Gln

SEQ ID NO: 103
gtgctaacgtttcaccgcatcattcgaaaaggatggatgttcctgctcgcgttttgctcactgcctcgctgttctgcccaacaggacagcccgcca
aggctgccgcaccgtttaacggcaccatgatgcagtattttgaatggtacttgccggatgatggcacgttatggaccaaagtggccaatgaagc
caacaacttatccagccttggcatcaccgctctttggctgccgcccgcttacaaaggaacaagccgcagcgacgtagggtacggagtatacga
cttgtatgacctcggcgaattcaatcaaaaagggaccgtccgcacaaaatacggaacaaaagctcaatatcttcaagccattcaagccgccac
gccgctggaatgcaagtgtacgccgatgtcgtgttcgaccataaaggcggcgccgacggcacggaatgggtggacgccgtcgaagtcaatc
cgtccgaccgcaaccaagaaatctcgggcacctatcaaatccaagcatggacgaaatttgatttccgggcggggcaacacctactccagctt
taagtggcgctggtaccattttgacggcgttgattgggacgaaagccgaaaattgagccgcatttacaaattccgcggcatcggcaaagcgtgg
gattgggaagtagacacggaaaacggaaactatgactacttaatgtatgccgaccttgatatggatcatcccgaagtcgtgaccgagctgaaaa
actggggggaatggtatgtcaacacaacgaacattgatgggttccggcttgatgccgtcaagcatattaagttcagttttttcctgattggttgtcgt
atgtgcgttctcagactggcaagccgctatttaccgtcggggaatattggagctatgacatcaacaagttgcacaattacattacgaaaacaaacg
gaacgatgtctttgtttgatgccccgttacacaacaaattttataccgcttccaaatcagggggcgcatttgatatgcgcacgttaatgaccaatact
ctcatgaaagatcaaccgacattggccgtcaccttcgttgataatcatgacaccgaacccggccaagcgctgcagtcatgggtcgacccatggt
tcaaaccgttggcttacgcctttattctaactcggcaggaaggataccccgtgcgtcttttatggtgactattatggcattccacaatataacattccttc
gctgaaaagcaaaatcgatccgctcctcatcgcgcgcagggattatgcttacggaacgcaacatgattatcttgatcactccgacatcatcgggt
ggacaagggaagggtcactgaaaaaccaggatccgggctggccgcactgatcacogatgggccgggaggaagcaaatggatgtacgttg
gcaaacaacacgctggaaaagtgttctatgaccttaccggcaaccggagtgacaccgtcaccatcaacagtgatggatggggggaattcaaa
gtcaatggcggttcggtttcggtttgggttcctagaaaaacgaccgtttctaccatcgctcggccgatcacaacccgaccgtggactggtgaattc
gtccgttggaccgaaccacggttggtggcatggccttga SEQ ID NO: 104
Val Leu Thr Phe His Arg Ile Ile Arg Lys Gly Trp Met Phe Leu Leu Ala Phe Leu Leu Thr Ala Ser
Leu Phe Cys Pro Thr Gly Gln Pro Ala Lys Ala Ala Ala Pro Phe Asn Gly Thr Met Met Gln Tyr Phe
Glu Trp Tyr Leu Pro Asp Asp Gly Thr Leu Trp Thr Lys Val Ala Asn Glu Ala Asn Asn Leu Ser Ser
Leu Gly Ile Thr Ala Leu Trp Leu Pro Pro Ala Tyr Lys Gly Thr Ser Arg Ser Asp Val Gly Tyr Gly
Val Tyr Asp Leu Tyr Asp Leu Gly Glu Phe Asn Gln Lys Gly Thr Val Arg Thr Lys Tyr Gly Thr
Lys Ala Gln Tyr Leu Gln Ala Ile Gln Ala Ala His Ala Ala Gly Met Gln Val Tyr Ala Asp Val Val
Phe Asp His Lys Gly Gly Ala Asp Gly Thr Glu Trp Val Asp Ala Val Glu Val Asn Pro Ser Asp Arg
Asn Gln Glu Ile Ser Gly Thr Tyr Gln Ile Gln Ala Trp Thr Lys Phe Asp Phe Pro Gly Arg Gly Asn
Thr Tyr Ser Ser Phe Lys Trp Arg Trp Tyr His Phe Asp Gly Val Asp Trp Asp Glu Ser Arg Lys Leu
Ser Arg Ile Tyr Lys Phe Arg Gly Ile Gly Lys Ala Trp Asp Trp Glu Val Asp Thr Glu Asn Gly Asn
Tyr Asp Tyr Leu Met Tyr Ala Asp Leu Asp Met Asp His Pro Glu Val Val Thr Glu Leu Lys Asn
Trp Gly Glu Trp Tyr Val Asn Thr Thr Asn Ile Asp Gly Phe Arg Leu Asp Ala Val Lys His Ile Lys
Phe Ser Phe Phe Pro Asp Trp Leu Ser Tyr Val Arg Ser Gln Thr Gly Lys Pro Leu Phe Thr Val Gly

FIGURE 160O

Glu Tyr Trp Ser Tyr Asp Ile Asn Lys Leu His Asn Tyr Ile Thr Lys Thr Asn Gly Thr Met Ser Leu
Phe Asp Ala Pro Leu His Asn Lys Phe Tyr Thr Ala Ser Lys Ser Gly Gly Ala Phe Asp Met Arg Thr
Leu Met Thr Asn Thr Leu Met Lys Asp Gln Pro Thr Leu Ala Val Thr Phe Val Asp Asn His Asp
Thr Glu Pro Gly Gln Ala Leu Gln Ser Trp Val Asp Pro Trp Phe Lys Pro Leu Ala Tyr Ala Phe Ile
Leu Thr Arg Gln Glu Gly Tyr Pro Cys Val Phe Tyr Gly Asp Tyr Tyr Gly Ile Pro Gln Tyr Asn Ile
Pro Ser Leu Lys Ser Lys Ile Asp Pro Leu Leu Ile Ala Arg Arg Asp Tyr Ala Tyr Gly Thr Gln His
Asp Tyr Leu Asp His Ser Asp Ile Ile Gly Trp Thr Arg Glu Gly Val Thr Glu Lys Pro Gly Ser Gly
Leu Ala Ala Leu Ile Thr Asp Gly Pro Gly Gly Ser Lys Trp Met Tyr Val Gly Lys Gln His Ala Gly
Lys Val Phe Tyr Asp Leu Thr Gly Asn Arg Ser Asp Thr Val Thr Ile Asn Ser Asp Gly Trp Gly Glu
Phe Lys Val Asn Gly Gly Ser Val Ser Val Trp Val Pro Arg Lys Thr Thr Val Ser Thr Ile Ala Arg
Pro Ile Thr Thr Arg Pro Trp Thr Gly Glu Phe Val Arg Trp Thr Glu Pro Arg Leu Val Ala Trp Pro

SEQ ID NO: 105
atgtccctattcaaaaaaatctttccgtggattgtatctctacttcttttgttttcgtttattgctccttttttcattcaaacagaaaaagtccgcgctggaa
gtgttccagtgaatggaacgatgatgcaatattcgaatggtaccttccagacgatggaacactatggacgaaagtagcaaataacgcccaatct
ttagcgaatcttggcattactgcccttggcttcccctgcctataaaggaacaagcagcagtgacgttggatatggcgtttatgatttatatgacct
aggagagtttaatcaaaaaggaactgtccgaacaaaatacggaacaaaaacacaatatatccaagcaatccaagcggcgcatacagcaggaa
tgcaagtatatgcagatgtcgtctttaaccataaagccggtgcagatgggacagaactagtggatgcagtagaagtaaaccttctgaccgcaat
caagaaatatcaggaacatatcaaatccaagcgtggacaaaatttgattttcctggtcgtggaaacacctattctagttttaaatggcgttggtatca
tttcgatggaacggactgggatgagagtagaaaactaaatcgtatttacaaattccgcggcacgggaaaagcatgggattgggaagtagataca
gaaaatgggaattatgactatctcatgtatgcagatttggatatggatcatccagaggttgtatctgaactaaaaaattggggaaagtggtatgtaa
ccacaaccaatatcgacggattccgtctggatgcagtgaagcatattaaatatagcttttcccagactggctatcgtatgtacgaacccaaacac
aaaagcctcttttttgccgttggcgaattttggagctatgacattaacaagctacacaactatattacaaagacgaacggctctatgtccctattcgat
gccccgctgcataacaattttatatagcatcgaaatcaggtggctattttgatatgcgcacattactcaacaacacattgatgaaagatcaaccaa
cactatcggtcacattagtagacaatcacgatactgagccagggcaatctttgcagtcgtgggtcgagccgtggtttaaaccgttagcttacgcat
ttatcttgacccgccaagaaggttatccgtgcatcttttatggagattactatggtattccaaaatacaacattcctgcgctgaaaagcaaacttgatc
cgctgttaattgctcgaagagattatgcctacggaacacagcacgactatattgacaatgcagatattatcggctggacgcgggaaggagtagct
gaaaaagcaaattcgggacttgctgcactcattaccgacggacctggcggaagcaaatggatgtatgttggcaaacaacacgctggcaaaac
gttttatgatctaaccggcaatcgaagtgatacagtgacaatcaacgctgatggatggggagaatttaaagtcaatggagggtctgtatccatatg
ggttccaaaaacatcaaccacttcccaaatcacatttactgtaaataatgccacaaccgtttggggacaaaatgtatacgttgtcgggaatatttcg
cagctgggcaac SEQ ID NO: 106
Met Ser Leu Phe Lys Lys Ile Phe Pro Trp Ile Val Ser Leu Leu Leu Phe Ser Phe Ile Ala Pro Phe
Ser Ile Gln Thr Glu Lys Val Arg Ala Gly Ser Val Pro Val Asn Gly Thr Met Met Gln Tyr Phe Glu
Trp Tyr Leu Pro Asp Asp Gly Thr Leu Trp Thr Lys Val Ala Asn Asp Ala Glu Ser Leu Ala Asn Leu
Gly Ile Thr Ala Leu Trp Leu Pro Pro Ala Tyr Lys Gly Thr Ser Ser Ser Asp Val Gly Tyr Gly Val
Tyr Asp Leu Tyr Asp Leu Gly Glu Phe Asn Gln Lys Gly Thr Val Arg Thr Lys Tyr Gly Thr Lys
Thr Gln Tyr Ile Gln Ala Ile Gln Ala Ala His Thr Ala Gly Met Gln Val Tyr Ala Asp Val Val Phe
Asn His Lys Ala Gly Ala Asp Gly Thr Glu Leu Val Asp Ala Val Glu Val Asn Pro Ser Asp Arg Asn
Gln Glu Ile Ser Gly Thr Tyr Gln Ile Gln Ala Trp Thr Lys Phe Asp Phe Pro Gly Arg Gly Asn Thr
Tyr Ser Ser Phe Lys Trp Arg Trp Tyr His Phe Asp Gly Thr Asp Trp Asp Glu Ser Arg Lys Leu Asn
Arg Ile Tyr Lys Phe Arg Gly Thr Gly Lys Ala Trp Asp Trp Glu Val Asp Thr Glu Asn Gly Asn Tyr
Asp Tyr Leu Met Tyr Ala Asp Leu Asp Met Asp His Pro Glu Val Val Ser Glu Leu Lys Asn Trp
Gly Lys Trp Tyr Val Thr Thr Asn Ile Asp Gly Phe Arg Leu Asp Ala Val Lys His Ile Lys Tyr
Ser Phe Phe Pro Asp Trp Leu Ser Tyr Val Arg Thr Gln Thr Gln Lys Pro Leu Phe Ala Val Gly Glu
Phe Trp Ser Tyr Asp Ile Asn Lys Leu His Asn Tyr Ile Thr Lys Thr Asn Gly Ser Met Ser Leu Phe
Asp Ala Pro Leu His Asn Asn Phe Tyr Ile Ala Ser Lys Ser Gly Gly Tyr Phe Asp Met Arg Thr Leu
Leu Asn Asn Thr Leu Met Lys Asp Gln Pro Thr Leu Ser Val Thr Leu Val Asp Asn His Asp Thr

FIGURE 16PP

Glu Pro Gly Gln Ser Leu Gln Ser Trp Val Glu Pro Trp Phe Lys Pro Leu Ala Tyr Ala Phe Ile Leu
Thr Arg Gln Glu Gly Tyr Pro Cys Ile Phe Tyr Gly Asp Tyr Tyr Gly Ile Pro Lys Tyr Asn Ile Pro
Ala Leu Lys Ser Lys Leu Asp Pro Leu Leu Ile Ala Arg Arg Asp Tyr Ala Tyr Gly Thr Gln His Asp
Tyr Ile Asp Asn Ala Asp Ile Ile Gly Trp Thr Arg Glu Gly Val Ala Glu Lys Ala Asn Ser Gly Leu
Ala Ala Leu Ile Thr Asp Gly Pro Gly Gly Ser Lys Trp Met Tyr Val Gly Lys Gln His Ala Gly Lys
Thr Phe Tyr Asp Leu Thr Gly Asn Arg Ser Asp Thr Val Thr Ile Asn Ala Asp Gly Trp Gly Glu Phe
Lys Val Asn Gly Gly Ser Val Ser Ile Trp Val Pro Lys Thr Ser Thr Thr Ser Gln Ile Thr Phe Thr Val
Asn Asn Ala Thr Thr Val Trp Gly Gln Asn Val Tyr Val Val Gly Asn Ile Ser Gln Leu Gly Asn

SEQ ID NO: 107
atggacagcctcgacgcgccggagcagaagccctgggtgaaggatggcaggctctccgcgtacctggatacagggacagggaccgtggtc
gctcccgaggcacctgcgccccgccgccccggccgaggaagtccggcccgtggacaagtggaaaaacgatatcatctatttcgtcctcac
cgaccgtttccaggatggcgacaagaccaacaacatggacgtggtcccgacggacatgaaaaaatatcatggcggcgacatccagggctc
atcgacaagctcgactatatcaaggagaccggttcgacggccatctggctcacgcccctatgaaggggcagacccacttcttcgagaccgac
aattaccatggttactggcccattgacttctatgacacggacccccatgtgggcaccatgcagaaatttgaggagcttatcgagaaagcccatga
gaaagggctgaagatcgtgctcgatattccctgaaccacacggcctgggagcatcccttctacaaggacgacagcaagaaggactggttcc
accatataggagatgtgaaggactgggaagatccctactgggctgaaaacggctccatattcggtcttcctgacctggcgcaggaaaaccctg
ccgtggaaaagtacctcatcgacgtggccaagttctgggtagacaagggtattgacggcttcaggcttgacgccgtgaagaacgtgccccta
acttctgggcgaagtttgaccgggcgattcacgattatgcgggcaaggacttcctcctcgtcggggaatactttgacggaaacccggcgaaagt
cgcgaactaccagagagaggacatgagctcactcttcgattaccgctctactggacccgaaggacaccttcgccaaggacgggagcatgc
gcaacctggcggcgaagcttgatgagtgcgacaggaattatcccgacccgggcctcatgtcggttttccttgataaccacgacacgccgaggtt
cctcaccgaggccaacggcaacaaggataagctcaaactggccctcgccttcgcgatgaccatcaaccgcatgcctaccatttattatggcacc
gaggttgccatggaaggcaactgcgatatcatgggcgccgtagataaccggagggacatgcagtgggacaaggatcctgacatgttcaaata
cttcaagactctcaccactgcccgcaatgagcatgaatccctcagggaaggaaagaagctcgagatgtggcaggatgacaaagtctacgcgta
cgggaggcagaccccgaaggacgagtctatcgtggtgcttaacaacggctatgatacgcaggaacgggacataccgctccgccccgagag
cggcatcaagaacggcacggtgctgaaggatgtcatcaccggcgaaaccgtgacggtacagaacggaaaaatccatgcgaaatgcggcgg
caaacaggcgcggatctacgtgcccgcgtag SEQ ID NO: 108
Met Asp Ser Leu Asp Ala Pro Glu Gln Lys Pro Trp Val Lys Asp Gly Arg Leu Ser Ala Tyr Leu Asp
Thr Gly Thr Gly Thr Val Val Ala Pro Glu Ala Pro Ala Pro Pro Pro Pro Ala Glu Glu Val Arg
Pro Val Asp Lys Trp Lys Asn Asp Ile Ile Tyr Phe Val Leu Thr Asp Arg Phe Gln Asp Gly Asp Lys
Thr Asn Asn Met Asp Val Val Pro Thr Asp Met Lys Lys Tyr His Gly Gly Asp Ile Gln Gly Leu Ile
Asp Lys Leu Asp Tyr Ile Lys Glu Thr Gly Ser Thr Ala Ile Trp Leu Thr Pro Pro Met Lys Gly Gln
Thr His Phe Phe Glu Thr Asp Asn Tyr His Gly Tyr Trp Pro Ile Asp Phe Tyr Asp Thr Asp Pro His
Val Gly Thr Met Gln Lys Phe Glu Glu Leu Ile Glu Lys Ala His Glu Lys Gly Leu Lys Ile Val Leu
Asp Ile Pro Leu Asn His Thr Ala Trp Glu His Pro Phe Tyr Lys Asp Asp Ser Lys Lys Asp Trp Phe
His His Ile Gly Asp Val Lys Asp Trp Glu Asp Pro Tyr Trp Ala Glu Asn Gly Ser Ile Phe Gly Leu
Pro Asp Leu Ala Gln Glu Asn Pro Ala Val Glu Lys Tyr Leu Ile Asp Val Ala Lys Phe Trp Val Asp
Lys Gly Ile Asp Gly Phe Arg Leu Asp Ala Val Lys Asn Val Pro Leu Asn Phe Trp Ala Lys Phe Asp
Arg Ala Ile His Asp Tyr Ala Gly Lys Asp Phe Leu Leu Val Gly Glu Tyr Phe Asp Gly Asn Pro Ala
Lys Val Ala Asn Tyr Gln Arg Glu Asp Met Ser Ser Leu Phe Asp Tyr Pro Leu Tyr Trp Thr Leu Lys
Asp Thr Phe Ala Lys Asp Gly Ser Met Arg Asn Leu Ala Ala Lys Leu Asp Glu Cys Asp Arg Asn
Tyr Pro Asp Pro Gly Leu Met Ser Val Phe Leu Asp Asn His Asp Thr Pro Arg Phe Leu Thr Glu Ala
Asn Gly Asn Lys Asp Lys Leu Lys Leu Ala Leu Ala Phe Ala Met Thr Ile Asn Arg Met Pro Thr Ile
Tyr Tyr Gly Thr Glu Val Ala Met Glu Gly Asn Cys Asp Ile Met Gly Ala Val Asp Asn Arg Arg
Asp Met Gln Trp Asp Lys Asp Pro Asp Met Phe Lys Tyr Phe Lys Thr Leu Thr Thr Ala Arg Asn
Glu His Glu Ser Leu Arg Glu Gly Lys Lys Leu Glu Met Trp Gln Asp Asp Lys Val Tyr Ala Tyr Gly
Arg Gln Thr Pro Lys Asp Glu Ser Ile Val Val Leu Asn Asn Gly Tyr Asp Thr Gln Glu Arg Asp Ile

FIGURE 16QQ

Pro Leu Arg Pro Glu Ser Gly Ile Lys Asn Gly Thr Val Leu Lys Asp Val Ile Thr Gly Glu Thr Val Thr Val Gln Asn Gly Lys Ile His Ala Lys Cys Gly Gly Lys Gln Ala Arg Ile Tyr Val Pro Ala

SEQ ID NO: 109
atggcaagaaaaacgctggccatattttcgtacttctagtgcttcttagtctctcggcagttccggcaaaggcagaaactctagagaatggtgga
gttataatgcaggctttctattgggatgttcctggaggaggaatctggtgggacacaatagctcaaaagatacccgaatgggcaagtgcaggaat
ctcagcgatatggattccaccagcgagtaagggcatgagcggtggttattccatgggctacgatccctacgatttctttgacctcggcgagtacta
tcagaaggggacagttgagacgcgcttcggctcaaaggaagaactggtgaacatgataaacaccgcacactcctacggcataaaggtgatag
cggacatagtcataaaccaccgcgccggtggagaccttgagtgaaccccttcgtgaacgactatacctggacagacttctcaaaagtcgcctc
cggtaaatatacggccaactaccttgacttccacccaaacgagcttcactgttgtgatgaaggtacctttggaggatacccctgatatatgtcacga
caaaagctgggaccagtactggctctgggcgagcagcgaaagctacgctgcctacctcaggagcataggggttgacgcctggcgtttcgact
acgtcaagggctacggagcatgggttgttaacgactggctcagctggtggggaggctgggccgttggagagtactgggacacgaacgttgat
gcactcctcaactgggcatacagcagcggcgccaaggtctttgacttcccgctctactacaagatggacgaagccttcgacaacaccaacatcc
cggcattagtggatgcactcagatacggccagacagtggtcagccgcgatcccttcaaggcggtaactttcgttgccaaccacgatacagatat
aatctggaacaagtatccggcttatgcattcatccttacctatgagggacagcctgttatattctaccgcgactacgaggagtggctcaacaagga
taagcttaacaacctcatctggatacacgatcaccttgctggagggagtactgacattgtttactacgacagccgacgagcttatctttgtgagaaac
ggctatggcaccaaaccaggactgataacctatatcaacctcggctcaagcaaagttggaaggtgggtctacgttccaaagttcgccggttcat
gcatccacgagtacaccggcaacctcggcggttggatagacaagtacgtctcctccagcggctgggtctatcttgaggcccagcccacgac
ccggcgaacggctactacggctactctgtctggagctactgcggtgtgggttga SEQ ID NO: 110
Met Ala Arg Lys Thr Leu Ala Ile Phe Phe Val Leu Leu Val Leu Leu Ser Leu Ser Ala Val Pro Ala Lys Ala Glu Thr Leu Glu Asn Gly Gly Val Ile Met Gln Ala Phe Tyr Trp Asp Val Pro Gly Gly Gly Ile Trp Trp Asp Thr Ile Ala Gln Lys Ile Pro Glu Trp Ala Ser Ala Gly Ile Ser Ala Ile Trp Ile Pro Pro Ala Ser Lys Gly Met Ser Gly Gly Tyr Ser Met Gly Tyr Asp Pro Tyr Asp Phe Phe Asp Leu Gly Glu Tyr Tyr Gln Lys Gly Thr Val Glu Thr Arg Phe Gly Ser Lys Glu Glu Leu Val Asn Met Ile Asn Thr Ala His Ser Tyr Gly Ile Lys Val Ile Ala Asp Ile Val Ile Asn His Arg Ala Gly Gly Asp Leu Glu Trp Asn Pro Phe Val Asn Asp Tyr Thr Trp Thr Asp Phe Ser Lys Val Ala Ser Gly Lys Tyr Thr Ala Asn Tyr Leu Asp Phe His Pro Asn Glu Leu His Cys Cys Asp Glu Gly Thr Phe Gly Gly Tyr Pro Asp Ile Cys His Asp Lys Ser Trp Asp Gln Tyr Trp Leu Trp Ala Ser Ser Glu Ser Tyr Ala Ala Tyr Leu Arg Ser Ile Gly Val Asp Ala Trp Arg Phe Asp Tyr Val Lys Gly Tyr Gly Ala Trp Val Val Asn Asp Trp Leu Ser Trp Trp Gly Gly Trp Ala Val Gly Glu Tyr Trp Asp Thr Asn Val Asp Ala Leu Leu Asn Trp Ala Tyr Ser Ser Gly Ala Lys Val Phe Asp Phe Pro Leu Tyr Tyr Lys Met Asp Glu Ala Phe Asp Asn Thr Asn Ile Pro Ala Leu Val Asp Ala Leu Arg Tyr Gly Gln Thr Val Val Ser Arg Asp Pro Phe Lys Ala Val Thr Phe Val Ala Asn His Asp Thr Asp Ile Ile Trp Asn Lys Tyr Pro Ala Tyr Ala Phe Ile Leu Thr Tyr Glu Gly Gln Pro Val Ile Phe Tyr Arg Asp Tyr Glu Glu Trp Leu Asn Lys Asp Lys Leu Asn Asn Leu Ile Trp Ile His Asp His Leu Ala Gly Gly Ser Thr Asp Ile Val Tyr Tyr Asp Ser Asp Glu Leu Ile Phe Val Arg Asn Gly Tyr Gly Thr Lys Pro Gly Leu Ile Thr Tyr Ile Asn Leu Gly Ser Ser Lys Val Gly Arg Trp Val Tyr Val Pro Lys Phe Ala Gly Ser Cys Ile His Glu Tyr Thr Gly Asn Leu Gly Gly Trp Ile Asp Lys Tyr Val Ser Ser Ser Gly Trp Val Tyr Leu Glu Ala Pro Ala His Asp Pro Ala Asn Gly Tyr Tyr Gly Tyr Ser Val Trp Ser Tyr Cys Gly Val Gly SEQ ID NO: 111
atgcccgcgttcaaatctaaggtgatgcacatgaagttgaagtaccttgctttagttttgttggctgtggcttcgataggcctcctctcgactccagt
gggtgctgccaagtactccgaactcgaagagggcggtgttataatgcaggccttctactgggacgtccctaccggtgggatctggtgggacac
cataagacagaaaatcccggagtggtacgacgctggaatctcggcgatatggattcctccagctagcaaaggtatgggtggtgcatactccatg
ggttatgaccctacgatttctttgacctcggcgagtactatcagaagggaacagttgagacgcgcttcggctcaaaggaggaactggtgaaca
tgataaacaccgcacactcctatggcataaaggtgatagcggacatagtcataaaccaccgcgccggcggcgaccttgagtggaaccccttg
taaacaactatacttggacagacttctccaaggtcgcctccggtaaatacacggccaactaccttgacttccacccaaacgaggtcaagtgctgc
gatgagggtacattggtgacttccggacatcgcccacgagaagagctggaatcagtactggctctgggcaagcaatgagagctacgccgcc

FIGURE 16RR tatctccggagcatagggatcgatgcatggcgtttcgactacgtcaaaggttacggagcgtgggttgttaacgactggctcagctggtggggag
gttgggccgttggagagtactgggacaccaacgttgatgcactccttaactgggcatacaacagcggtgccaaggtctttgacttcccgctctac
tacaagatggacgaagcctttgacaacaccaacatccccgctttggtttacgccctccagaaacggaggaacagtcgtttcccgcgatcccttcaa
ggcagtaactttcgttgccaaccacgataccgatataatctggaacaagtatccggcttatgcgttcatccttacctatgagggacagcctgttatat
tctaccgcgactacgaggagtggctcaacaaggataagcttaacaaccttatctggatacacgagcaccttgccggaggaagtaccaagatcct
ctactacgataacgatgagctaatattcatgagggagggctacgggagcaagccgggcctcataacctacataaacctcggaaacgactggg
ccgagcgctgggtgaacgtcggctcaaagtttgccggctacacaatccatgaatacacaggcaatctcggtggctgggttgacaggtgggttc
agtacgacggatgggttaaactgacggcacctcctcacgatccagccaacggatatattacggctactcagtctggagctacgcaggcgtcggat
ga SEQ ID NO: 112
Met Pro Ala Phe Lys Ser Lys Val Met His Met Lys Leu Lys Tyr Leu Ala Leu Val Leu Leu Ala Val
Ala Ser Ile Gly Leu Leu Ser Thr Pro Val Gly Ala Ala Lys Tyr Ser Glu Leu Glu Glu Gly Gly Val Ile
Met Gln Ala Phe Tyr Trp Asp Val Pro Thr Gly Gly Ile Trp Trp Asp Thr Ile Arg Gln Lys Ile Pro
Glu Trp Tyr Asp Ala Gly Ile Ser Ala Ile Trp Ile Pro Pro Ala Ser Lys Gly Met Gly Gly Ala Tyr Ser
Met Gly Tyr Asp Pro Tyr Asp Phe Phe Asp Leu Gly Glu Tyr Tyr Gln Lys Gly Thr Val Glu Thr
Arg Phe Gly Ser Lys Glu Glu Leu Val Asn Met Ile Asn Thr Ala His Ser Tyr Gly Ile Lys Val Ile
Ala Asp Ile Val Ile Asn His Arg Ala Gly Gly Asp Leu Glu Trp Asn Pro Phe Val Asn Asn Tyr Thr
Trp Thr Asp Phe Ser Lys Val Ala Ser Gly Lys Tyr Thr Ala Asn Tyr Leu Asp Phe His Pro Asn Glu
Val Lys Cys Cys Asp Glu Gly Thr Phe Gly Asp Phe Pro Asp Ile Ala His Glu Lys Ser Trp Asp Gln
Tyr Trp Leu Trp Ala Ser Asn Glu Ser Tyr Ala Ala Tyr Leu Arg Ser Ile Gly Ile Asp Ala Trp Arg
Phe Asp Tyr Val Lys Gly Tyr Gly Ala Trp Val Val Asn Asp Trp Leu Ser Trp Trp Gly Gly Trp Ala
Val Gly Glu Tyr Trp Asp Thr Asn Val Asp Ala Leu Leu Asn Trp Ala Tyr Asn Ser Gly Ala Lys Val
Phe Asp Phe Pro Leu Tyr Tyr Lys Met Asp Glu Ala Phe Asp Asn Thr Asn Ile Pro Ala Leu Val Tyr
Ala Leu Gln Asn Gly Gly Thr Val Val Ser Arg Asp Pro Phe Lys Ala Val Thr Phe Val Ala Asn His
Asp Thr Asp Ile Ile Trp Asn Lys Tyr Pro Ala Tyr Ala Phe Ile Leu Thr Tyr Glu Gly Gln Pro Val Ile
Phe Tyr Arg Asp Tyr Glu Glu Trp Leu Asn Lys Asp Lys Leu Asn Asn Leu Ile Trp Ile His Glu His
Leu Ala Gly Gly Ser Thr Lys Ile Leu Tyr Tyr Asp Asn Asp Glu Leu Ile Phe Met Arg Glu Gly Tyr
Gly Ser Lys Pro Gly Leu Ile Thr Tyr Ile Asn Leu Gly Asn Asp Trp Ala Glu Arg Trp Val Asn Val
Gly Ser Lys Phe Ala Gly Tyr Thr Ile His Glu Tyr Thr Gly Asn Leu Gly Gly Trp Val Asp Arg Trp
Val Gln Tyr Asp Gly Trp Val Lys Leu Thr Ala Pro His Asp Pro Ala Asn Gly Tyr Tyr Gly Tyr
Ser Val Trp Ser Tyr Ala Gly Val Gly SEQ ID NO: 113
atgaaacaacaaaaacggctttacgcccgattgctgacgctgttatttgcgctcatcttcttgctgcctcattctgcagcagcggcggcaaatctta
atgggacgctgatgcagtattttgaatggtacatgccaaatgacggcaacattggaagcgcttgcaaaacgactcggcatatttggctgaagac
gatattactggtcgaattctccggcgatatggggaaattacgaaagcggatgtggggctacggtgcttacgaccttataattggaggagtt
cattcaaaagaggacggttggacaaaggtacggtacaaaagttgagctgcaatctgcgatcaaaagtcttcattccgcgacattaacgtttacg
gggatgtggtcatcaaccacaaaggcggcgctgatgcgaccgaagatgtaaccgcggttgaagtcgatcccgctgaccgcaaccgcgtaatt
tcaggagaacaccgaattaaagcctggacacattttcattttccggggcgcggcagcacatacagcgatttaaatggcattggtaccatttgac
ggaaccgattgggacgagtcccgaaagctgaaccgcatctataagtttcaaggaaaggcttgggattgggaagtttccaatgaaaacggcaac
tatgattatttgatgtatgccgacatcgattatgaccatcctgatgtcgcagcagaaattaagagatggggcacttggtatgccaatgaactgcaatt
ggacggtttccgtcttgatgctgtcaaacacattaaatttctttttttgcgggattgggttaatcatgtcaggggaaaaaacggggaaggaaatgttta
cggtagctgaatattggcagaatgacttgggcgcgctggaaaactatttgaacaaaacaaattttaatcattcagtgtttgacgtgccgcttcattat
cagttccatgctgcatcgacacagggaggcggctatgatatgaggaaattgctgaacggtacggtcgtttccaagcatccgttgaaagcggtta
catttgtcgataaccatgatacacagccggggcaatcgcttgagtcgactgtccaaacatggtttaagccgcttgcttacgctttcattctcacaag
ggaatctggatacccctcaggttttctacggggatatgtacgggacgaaaggagactcccagcgcgaaattcctgccttgaaacacaaaattgaa
ccgatcttaaaagcgagaaaacagtatgcgtacggagcacagcatgattatttcgaccaccatgacattgtcggctggacaagggaaggcgac
agctcggttgcaaattcaggtttggcggcattaataacagacggacccggtggggcaaagcgaatgtatgtcggccggcaaaacgccggtga

FIGURE 16SS gacatggcatgacattaccggaaaaccgttcggagccggttgtcatcaattcggaaggctggggagagtttcacgtaaacggcgggtcggtttca
atttatgttcaaagatag SEQ ID NO: 114
Met Lys Gln Gln Lys Arg Leu Tyr Ala Arg Leu Leu Thr Leu Leu Phe Ala Leu Ile Phe Leu Leu Pro
His Ser Ala Ala Ala Ala Ala Asn Leu Asn Gly Thr Leu Met Gln Tyr Phe Glu Trp Tyr Met Pro Asn
Asp Gly Gln His Trp Lys Arg Leu Gln Asn Asp Ser Ala Tyr Leu Ala Glu His Gly Ile Thr Ala Val
Trp Ile Pro Pro Ala Tyr Lys Gly Thr Ser Gln Ala Asp Val Gly Tyr Gly Ala Tyr Asp Leu Tyr Asp
Leu Gly Glu Phe His Gln Lys Gly Thr Val Arg Thr Lys Tyr Gly Thr Lys Gly Glu Leu Gln Ser Ala
Ile Lys Ser Leu His Ser Arg Asp Ile Asn Val Tyr Gly Asp Val Val Ile Asn His Lys Gly Gly Ala
Asp Ala Thr Glu Asp Val Thr Ala Val Glu Val Asp Pro Ala Asp Arg Asn Arg Val Ile Ser Gly Glu
His Arg Ile Lys Ala Trp Thr His Phe His Phe Pro Gly Arg Gly Ser Thr Tyr Ser Asp Phe Lys Trp
His Trp Tyr His Phe Asp Gly Thr Asp Trp Asp Glu Ser Arg Lys Leu Asn Arg Ile Tyr Lys Phe Gln
Gly Lys Ala Trp Asp Trp Glu Val Ser Asn Glu Asn Gly Asn Tyr Asp Tyr Leu Met Tyr Ala Asp Ile
Asp Tyr Asp His Pro Asp Val Ala Ala Glu Ile Lys Arg Trp Gly Thr Trp Tyr Ala Asn Glu Leu Gln
Leu Asp Gly Phe Arg Leu Asp Ala Val Lys His Ile Lys Phe Ser Phe Leu Arg Asp Trp Val Asn His
Val Arg Glu Lys Thr Gly Lys Glu Met Phe Thr Val Ala Glu Tyr Trp Gln Asn Asp Leu Gly Ala
Leu Glu Asn Tyr Leu Asn Lys Thr Asn Phe Asn His Ser Val Phe Asp Val Pro Leu His Tyr Gln Phe
His Ala Ala Ser Thr Gln Gly Gly Gly Tyr Asp Met Arg Lys Leu Leu Asn Gly Thr Val Val Ser Lys
His Pro Leu Lys Ala Val Thr Phe Val Asp Asn His Asp Thr Gln Pro Gly Gln Ser Leu Glu Ser Thr
Val Gln Thr Trp Phe Lys Pro Leu Ala Tyr Ala Phe Ile Leu Thr Arg Glu Ser Gly Tyr Pro Gln Val
Phe Tyr Gly Asp Met Tyr Gly Thr Lys Gly Asp Ser Gln Arg Glu Ile Pro Ala Leu Lys His Lys Ile
Glu Pro Ile Leu Lys Ala Arg Lys Gln Tyr Ala Tyr Gly Ala Gln His Asp Tyr Phe Asp His His Asp
Ile Val Gly Trp Thr Arg Glu Gly Asp Ser Ser Val Ala Asn Ser Gly Leu Ala Ala Leu Ile Thr Asp
Gly Pro Gly Gly Ala Lys Arg Met Tyr Val Gly Arg Gln Asn Ala Gly Glu Thr Trp His Asp Ile Thr
Gly Asn Arg Ser Glu Pro Val Val Ile Asn Ser Glu Gly Trp Gly Glu Phe His Val Asn Gly Gly Ser
Val Ser Ile Tyr Val Gln Arg SEQ ID NO: 115
atggcgaagtactccgagctggagcagggcggagtcataatgcaggccttctactgggacgttccggagggaggaatctggtgggacacaat
acggcagaagatccctgaatggtacgatgcaggcatatccgccatctggataccccggcgagcaagggcatgggcggggcctactcgatg
ggctacgaccccctacgattacttcgatctgggcgagttttaccagaagggaaccgttgagacccgcttcggctccaaggaagagctcgtcaaca
tgatctccacggcccaccagtacggcatcaaggttatagcggacatagtgataaaccaccgcgcaggtggagacctcgaatggaacccatac
gtcggcgactataccctggacggacttttctaaggtcgcctccgggaaatacaaggcccactacatggacttccatccaaacaactacagcacct
cagacgagggaaccttcggtggcttcccagacattgatcacctcgtgcccttcaaccagtactggctgtgggcgagcaacgagagctacgccg
cctacctcaggagcataggggatggatgcgtggcggctttgactacgttaaggagctacggcgcgtgggtcgtcaaggactggctgagtcagtggg
gcggctggctcgtcggcgagtacgagaacaataacgtcgatgcggctccttaaactggcgcctacaggagcggcgcaaggtcttcgacttccc
gctctactacaaggtggacgaggccttgacaacaagtacattccgcgcctcgttacgccatccagaacggtgaaaccgtcgtcagcagggat
cccttcaaggccgttaccttcgtggctaaccacgatacgaacataatctggaacaagtaccctgcctatgccttcatccctgacctacgaaggtcag
cccgtcatcttctaccgcgactacgaggagtggctcaacaaggacaaactcaacaacctcatatggattcacgagcacctggcagggggaag
caccaagatcctctactacgacgacgatgagctcatcttcatgagggaaggctacggcgacaggcccgggcttataacctacatcaacctcggt
agcgactgggcggagagatgggtgaacgttggctcaaagttcgcgggctatacaatccacgaatacaccggaaacctcggcggctgggtcg
acaggtacgtccagtacgacggctgggtcaagcttaccgctccgccacacgatccggcaaacggctattacggctactcggtctggagctacg
ccggagttggaagatctcatcaccatcaccatcactaa SEQ ID NO: 116
Met Ala Lys Tyr Ser Glu Leu Glu Gln Gly Gly Val Ile Met Gln Ala Phe Tyr Trp Asp Val Pro Glu
Gly Gly Ile Trp Trp Asp Thr Ile Arg Gln Lys Ile Pro Glu Trp Tyr Asp Ala Gly Ile Ser Ala Ile Trp
Ile Pro Pro Ala Ser Lys Gly Met Gly Gly Ala Tyr Ser Met Gly Tyr Asp Pro Tyr Asp Tyr Phe Asp
Leu Gly Glu Phe Tyr Gln Lys Gly Thr Val Glu Thr Arg Phe Gly Ser Lys Glu Glu Leu Val Asn Met

FIGURE 16TT

Ile Ser Thr Ala His Gln Tyr Gly Ile Lys Val Ile Ala Asp Ile Val Ile Asn His Arg Ala Gly Gly Asp
Leu Glu Trp Asn Pro Tyr Val Gly Asp Tyr Thr Trp Thr Asp Phe Ser Lys Val Ala Ser Gly Lys Tyr
Lys Ala His Tyr Met Asp Phe His Pro Asn Asn Tyr Ser Thr Ser Asp Glu Gly Thr Phe Gly Gly Phe
Pro Asp Ile Asp His Leu Val Pro Phe Asn Gln Tyr Trp Leu Trp Ala Ser Asn Glu Ser Tyr Ala Ala
Tyr Leu Arg Ser Ile Gly Ile Asp Ala Trp Arg Phe Asp Tyr Val Lys Gly Tyr Gly Ala Trp Val Val
Lys Asp Trp Leu Ser Gln Trp Gly Gly Trp Ala Val Gly Glu Tyr Trp Asp Thr Asn Val Asp Ala Leu
Leu Asn Trp Ala Tyr Ser Ser Gly Ala Lys Val Phe Asp Phe Pro Leu Tyr Tyr Lys Met Asp Glu Ala
Phe Asp Asn Lys Asn Ile Pro Ala Leu Val Tyr Ala Ile Gln Asn Gly Glu Thr Val Val Ser Arg Asp
Pro Phe Lys Ala Val Thr Phe Val Ala Asn His Asp Thr Asn Ile Ile Trp Asn Lys Tyr Pro Ala Tyr
Ala Phe Ile Leu Thr Tyr Glu Gly Gln Pro Val Ile Phe Tyr Arg Asp Tyr Glu Glu Trp Leu Asn Lys
Asp Lys Leu Asn Asn Leu Ile Trp Ile His Glu His Leu Ala Gly Gly Ser Thr Lys Ile Leu Tyr Tyr
Asp Asp Asp Glu Leu Ile Phe Met Arg Glu Gly Tyr Gly Asp Arg Pro Gly Leu Ile Thr Tyr Ile Asn
Leu Gly Ser Asp Trp Ala Glu Arg Trp Val Asn Val Gly Ser Lys Phe Ala Gly Tyr Thr Ile His Glu
Tyr Thr Gly Asn Leu Gly Gly Trp Val Asp Arg Tyr Val Gln Tyr Asp Gly Trp Val Lys Leu Thr Ala
Pro Pro His Asp Pro Ala Asn Gly Tyr Tyr Gly Tyr Ser Val Trp Ser Tyr Ala Gly Val Gly Arg Ser
His His His His His His

SEQ ID NO: 117 ttgcgagtgttcctggttgtgccaaagctgagccgcccatttcaggcagagtcacaacaacaagacagggacataacaatgaaacacacagcg
ggaatgctggcgatcgcaggtatgctgatcgcccccttggcgcatgccgatgtcatactgcacgccttcaactggaaatacagtgaagtcaccg
ccaaggccgatctcatcaaggctgccggctacaagcaggtgctcatctcaccgcctctgaagtcctcgggcaacgagtggtgggctcgttacc
agccccaggatctgcgcctggtcgacacccccttggcaacaagcaggatctggagcagctgatcgccgcgatgcagacccggggcattgc
cgtctacgcggacgtggtgctcaaccacatggccaacgaaagctggaagcgcagcgacctcaactaccccggcagcgagctgctgcaaag
ctacgccggcaatccggcctactttgaacgccagaagctctttggcgatctggggcagaacttcctcgccggccaggattttcatccggaggg
tgcatcaccgactggaacaatccgggccatgtccagtactggcgactgtgcggcggggcgggtgacaaggggctgccggatctggacccca
acaactgggtggtgaaccagcaacaggcttacctgcaggcgctcaaggggatggggatcaagggttttcgggtcgatgcggtcaagcacatg
agcgattaccagatcaacgccgtgttcacccccgagatcaaacaggggatgcacgtctttggcgaggtgatcaccacggggggcgccggca
acagcgactatgagaacttcctcaaaccctacctcgacagcagcggccaggggccctacgacttccgctcttcgcctccctgcgtggagcgc
tgggctacggcggcagcatgaacctgctggccgatcccggtgcctatggtcaggcgctgccggggtagccgcgccgtcaccttcgccatcacc
cacgacatcccaccaacgacggtttccgctaccagatcctcaaccagaccgacgagagactggcctatgcctacctgctcggtcgcgatggc
ggttcgcctctggtctactccgatcacggtgaaaccagggacaaggacggattgcgctggcaggactactatctgcgcaccgatctcaaaggg
atgatccgcttccataacacagtgcagggtcaaccgatgcagctcatcggcagtaacgactgcttcgtgctgttcaagcgtggcaagcagggc
gtggtcggcatcaacaagtgcgactacgagcaggagtactggctcgatacggccagattcgagatgaactggtatcgcaactaccgggatgtg
ctcgaccagaatgccgtggtcaacgtgcagagccagtgggtaaggctgaccatcccggccccgcggcgccagaatgtggctgcaggagtga

SEQ ID NO: 118

Met Arg Val Phe Leu Val Val Pro Lys Leu Ser Arg Pro Phe Gln Ala Glu Ser Gln Gln Gln Asp Arg
Asp Ile Thr Met Lys His Thr Ala Gly Met Leu Ala Ile Ala Gly Met Leu Ile Ala Pro Leu Ala His
Ala Asp Val Ile Leu His Ala Phe Asn Trp Lys Tyr Ser Glu Val Thr Ala Lys Ala Asp Leu Ile Lys
Ala Ala Gly Tyr Lys Gln Val Leu Ile Ser Pro Pro Leu Lys Ser Ser Gly Asn Glu Trp Trp Ala Arg
Tyr Gln Pro Gln Asp Leu Arg Leu Val Asp Thr Pro Leu Gly Asn Lys Gln Asp Leu Glu Gln Leu Ile
Ala Ala Met Gln Thr Arg Gly Ile Ala Val Tyr Ala Asp Val Val Leu Asn His Met Ala Asn Glu Ser
Trp Lys Arg Ser Asp Leu Asn Tyr Pro Gly Ser Glu Leu Leu Gln Ser Tyr Ala Gly Asn Pro Ala Tyr
Phe Glu Arg Gln Lys Leu Phe Gly Asp Leu Gly Gln Asn Phe Leu Ala Gly Gln Asp Phe His Pro
Glu Gly Cys Ile Thr Asp Trp Asn Asn Pro Gly His Val Gln Tyr Trp Arg Leu Cys Gly Gly Ala Gly
Asp Lys Gly Leu Pro Asp Leu Asp Pro Asn Asn Trp Val Val Asn Gln Gln Gln Ala Tyr Leu Gln
Ala Leu Lys Gly Met Gly Ile Lys Gly Phe Arg Val Asp Ala Val Lys His Met Ser Asp Tyr Gln Ile
Asn Ala Val Phe Thr Pro Glu Ile Lys Gln Gly Met His Val Phe Gly Glu Val Ile Thr Thr Gly Gly
Ala Gly Asn Ser Asp Tyr Glu Asn Phe Leu Lys Pro Tyr Leu Asp Ser Ser Gly Gln Gly Ala Tyr Asp
Phe Pro Leu Phe Ala Ser Leu Arg Gly Ala Leu Gly Tyr Gly Gly Ser Met Asn Leu Leu Ala Asp Pro

FIGURE 16UU

Gly Ala Tyr Gly Gln Ala Leu Pro Gly Ser Arg Ala Val Thr Phe Ala Ile Thr His Asp Ile Pro Thr
Asn Asp Gly Phe Arg Tyr Gln Ile Leu Asn Gln Thr Asp Glu Arg Leu Ala Tyr Ala Tyr Leu Leu Gly
Arg Asp Gly Gly Ser Pro Leu Val Tyr Ser Asp His Gly Glu Thr Arg Asp Lys Asp Gly Leu Arg Trp
Gln Asp Tyr Tyr Leu Arg Thr Asp Leu Lys Gly Met Ile Arg Phe His Asn Thr Val Gln Gly Gln Pro
Met Gln Leu Ile Gly Ser Asn Asp Cys Phe Val Leu Phe Lys Arg Gly Lys Gln Gly Val Val Gly Ile
Asn Lys Cys Asp Tyr Glu Gln Glu Tyr Trp Leu Asp Thr Ala Arg Phe Glu Met Asn Trp Tyr Arg
Asn Tyr Arg Asp Val Leu Asp Gln Asn Ala Val Val Asn Val Gln Ser Gln Trp Val Arg Leu Thr Ile
Pro Ala Arg Gly Ala Arg Met Trp Leu Gln Glu

SEQ ID NO: 119
atgcaaacgtttgcattcttattttactcaaagaaaggatgggtgtgcatgaattatttgaaaaaagtgtggttgtattacgctatcgtcgctaccttaa
tcatttcctttcttacaccttttcaacagcacaagctaatactgcacctgttaacggaacaatgatgcaatatttcgaatgggacttacctaatgatgg
gacgctttggacgaaagtaaaaaatgaagctaccaatcttctttcactaggtatcacagcactatggctccctccagcatataaaggaacgagcc
aaagcgatgtcggatacggtgtttacgatttatatgaccttggggaatttaatcaaaaagggacgatccgaacgaaatacggaacaaaaacaca
atatattcaagccattcaaactgcccaagccgcagggatgcaagtatatgcggatgttgtatttaatcataaggcagggctgacagtacagaatt
tgtcgatgcagttgaggtaaacccttctaatcgaaatcaagaaacatctggcacatatcaaattcaagcatggacaaaatttgattttcctggtcgtg
gaaacacatactccagcttcaaatggcgctggtaccattttgatggtacggattgggacgaaagtcgtaaattaaatcgtatttacaaattccgcgg
tacaggaaaagcgtgggactgggaagtcgatacagaaaacggaaactatgattatttaatgttcgctgatttagatatggatcaccctgaggttgt
gacagaattaaaaaactggggaacgtggtacgtcaatactacaaatatcgatggattccgcttagatgccgtaaaacatattaaatacagcttttc
cctgactggctaacatatgtacgtaatcaaacaggaaaaaatttatttgccgttggggaattttggagctatgacgtcaataagctgcataattacat
tacaaaaacaaatgggtcgatgtcattatttgatgcaccctttgcataacaacttttataccgcttccaaatcgagtggatattttgacatgcgttatttat
tgaataatacattaatgaaagatcaaccttcactcgctgtaacactigtcgataaccacgacacgcaaccagggcaatcttttacagtcatgggtcg
aaccttggtttaaacagcttgcttacgcctttattttaacaagacaagaagggtatccttgcgtattttacggtgattattatggaatccctaaatacaat
atcccggggttaaaaagtaaaatcgacccgcttttaattgctcgtcgtgattacgcttatggaacacaacgtgattacattgatcatcaagacattat
cggatggacacgagaaggcattgatgcaaaaccgaactctggactggcggcttaattaccgacggtcctggtggaagtaaatggatgtatgtc
ggtaaaaagcatgccgggaaagtattttatgatttaactggaaatcgaagtgacacagtaacgattaatgcggatggttggggagaatttaaagta
aacggaggatccgtctcaatttgggtggctaaaacgtcaaacgtcacatttacagtcaataacgccacaacaacaagcggacaaaacgtatatg
ttgtcggcaacattccagagctaggcaattgtcgcacgggttaa SEQ ID NO: 120
Met Gln Thr Phe Ala Phe Leu Phe Tyr Ser Lys Lys Gly Trp Val Cys Met Asn Tyr Leu Lys Lys Val
Trp Leu Tyr Tyr Ala Ile Val Ala Thr Leu Ile Ile Ser Phe Leu Thr Pro Phe Ser Thr Ala Gln Ala Asn
Thr Ala Pro Val Asn Gly Thr Met Met Gln Tyr Phe Glu Trp Asp Leu Pro Asn Asp Gly Thr Leu
Trp Thr Lys Val Lys Asn Glu Ala Thr Asn Leu Ser Ser Leu Gly Ile Thr Ala Leu Trp Leu Pro Pro
Ala Tyr Lys Gly Thr Ser Gln Ser Asp Val Gly Tyr Gly Val Tyr Asp Leu Tyr Asp Leu Gly Glu Phe
Asn Gln Lys Gly Thr Ile Arg Thr Lys Tyr Gly Thr Lys Thr Gln Tyr Ile Gln Ala Ile Gln Thr Ala
Gln Ala Ala Gly Met Gln Val Tyr Ala Asp Val Val Phe Asn His Lys Ala Gly Ala Asp Ser Thr Glu
Phe Val Asp Ala Val Glu Val Asn Pro Ser Asn Arg Asn Gln Glu Thr Ser Gly Thr Tyr Gln Ile Gln
Ala Trp Thr Lys Phe Asp Phe Pro Gly Arg Gly Asn Thr Tyr Ser Ser Phe Lys Trp Arg Trp Tyr His
Phe Asp Gly Thr Asp Trp Asp Glu Ser Arg Lys Leu Asn Arg Ile Tyr Lys Phe Arg Gly Thr Gly Lys
Ala Trp Asp Trp Glu Val Asp Thr Glu Asn Gly Asn Tyr Asp Tyr Leu Met Phe Ala Asp Leu Asp
Met Asp His Pro Glu Val Val Thr Glu Leu Lys Asn Trp Gly Thr Trp Tyr Val Asn Thr Thr Asn Ile
Asp Gly Phe Arg Leu Asp Ala Val Lys His Ile Lys Tyr Ser Phe Phe Pro Asp Trp Leu Thr Tyr Val
Arg Asn Gln Thr Gly Lys Asn Leu Phe Ala Val Gly Glu Phe Trp Ser Tyr Asp Val Asn Lys Leu His
Asn Tyr Ile Thr Lys Thr Asn Gly Ser Met Ser Leu Phe Asp Ala Pro Leu His Asn Asn Phe Tyr Thr
Ala Ser Lys Ser Ser Gly Tyr Phe Asp Met Arg Tyr Leu Leu Asn Asn Thr Leu Met Lys Asp Gln
Pro Ser Leu Ala Val Thr Leu Val Asp Asn His Asp Thr Gln Pro Gly Gln Ser Leu Gln Ser Trp Val
Glu Pro Trp Phe Lys Gln Leu Ala Tyr Ala Phe Ile Leu Thr Arg Gln Glu Gly Tyr Pro Cys Val Phe
Tyr Gly Asp Tyr Tyr Gly Ile Pro Lys Tyr Asn Ile Pro Gly Leu Lys Ser Lys Ile Asp Pro Leu Leu Ile
Ala Arg Arg Asp Tyr Ala Tyr Gly Thr Gln Arg Asp Tyr Ile Asp His Gln Asp Ile Ile Gly Trp Thr

FIGURE 16VV

Arg Glu Gly Ile Asp Ala Lys Pro Asn Ser Gly Leu Ala Ala Leu Ile Thr Asp Gly Pro Gly Gly Ser
Lys Trp Met Tyr Val Gly Lys Lys His Ala Gly Lys Val Phe Tyr Asp Leu Thr Gly Asn Arg Ser Asp
Thr Val Thr Ile Asn Ala Asp Gly Trp Gly Glu Phe Lys Val Asn Gly Gly Ser Val Ser Ile Trp Val
Ala Lys Thr Ser Asn Val Thr Phe Thr Val Asn Asn Ala Thr Thr Thr Ser Gly Gln Asn Val Tyr Val
Val Gly Asn Ile Pro Glu Leu Gly Asn Cys Arg Thr Gly

SEQ ID NO: 121
atgctcgccctgtcgctcggcggctgcggcatcgacgcgggcccgacaggccctcgcgtcgtggagccgctgccgcagcgccccacgcttc
cgcaggagtaccgcgccagcggccacgcggccgccggcgacgtgttcgtgcacctgttcgagtggaagtggccggacatcgcggaggaat
gcgagaacgtgctggggccggcgggctacgaggcggtgcaggtgtcgccgccgcaggagcacctggtgcagcagggggcgccgtggtg
gcagcggtaccagccggtgagctactcggtggcgctgagccgcagcggcacgggcgtggagttcagcaacatgatcagccggtgcaaggc
cgccggcgtggacatctacgtggacgccgtcatcaaccacatgacggccggtgcggggacggggagcaacggcaccgcctacaccaagta
caactacccgggcctgtacgcgcaggcggactttcaccgcagtgcgcggtgggcgactacaccagcgccgccaacgtgcaggactgcga
actgctggggctggctgacctgaacaccggcgcggccggcgtgcagcagaagatcgcggactacctggtctcgctggcgcggctggcgt
ggcgggttttcgcatcgacgccgccaagcacatccagccggtggaactggacgccatcgtggaccgcgtgaaccagacgctggcggcgga
ggggcgcccgcttccctactggttcgccgaggtgatcgacaacggcggcgaggggggtgcggcgcgagcactactacggcctgggatacgg
caccggcggcgccgcggacatcacggagttccgctacaagggcgtgggcgacaagttcctgggcagcggcggccagcggctggtggacc
tgaagaacttctcggcggtgacgtgaacctgatgccgtcggacaaggccgtcgtcttctggagaaccacgatacgcagcgcggcggcggc
atcggctaccgcgatggcacggcgttccggctggccaacgtgtggatgctggcgcagccgtacggctatccgtcggtgatgtccagctacgc
ctttgaccgcacctccccctttggccgcgacgccggccgccctccgaggacggcgcgacgaaggacgtgacgtgcgcgcccacgctgga
gacggcggtgctgggcacctgggtgtgcgagcaccgcgaccccgtcattcagcggatggtggcgtttcgccgcgcgatggcgggcacgga
cctgaaccgctggtgggacaacggcggcaacgccattgccttttcgcgcggggaccgggcgcttcgtcgccatcagccgcgagccgaaggtg
accatggcggccgtgcccagcggactgtccccggcacctactgcgacgtgctgaccggcggcaaggtgggcaacgcctgcgcgggaac
cagcgtgacggtcgactctcagggcgtggtgcagctgagcatcgtcgagaactcggctctggtgatccacctcggggccaagctgtaacggc
gcgctggcggatgtgcggaggg SEQ ID NO: 122
Met Leu Ala Leu Ser Leu Gly Gly Cys Gly Ile Asp Ala Gly Pro Thr Gly Pro Arg Val Val Glu Pro
Leu Pro Gln Arg Pro Thr Leu Pro Gln Glu Tyr Arg Ala Ser Gly His Ala Ala Ala Gly Asp Val Phe
Val His Leu Phe Glu Trp Lys Trp Pro Asp Ile Ala Glu Glu Cys Glu Asn Val Leu Gly Pro Ala Gly
Tyr Glu Ala Val Gln Val Ser Pro Pro Gln Glu His Leu Val Gln Gln Gly Ala Pro Trp Trp Gln Arg
Tyr Gln Pro Val Ser Tyr Ser Val Ala Leu Ser Arg Ser Gly Thr Gly Val Glu Phe Ser Asn Met Ile
Ser Arg Cys Lys Ala Ala Gly Val Asp Ile Tyr Val Asp Ala Val Ile Asn His Met Thr Ala Gly Ala
Gly Thr Gly Ser Asn Gly Thr Ala Tyr Thr Lys Tyr Asn Tyr Pro Gly Leu Tyr Ala Gln Ala Asp Phe
His Pro Gln Cys Ala Val Gly Asp Tyr Thr Ser Ala Ala Asn Val Gln Asp Cys Glu Leu Leu Gly Leu
Ala Asp Leu Asn Thr Gly Ala Ala Gly Val Gln Gln Lys Ile Ala Asp Tyr Leu Val Ser Leu Ala Arg
Leu Gly Val Ala Gly Phe Arg Ile Asp Ala Ala Lys His Ile Gln Pro Val Glu Leu Asp Ala Ile Val
Asp Arg Val Asn Gln Thr Leu Ala Ala Glu Gly Arg Pro Leu Pro Tyr Trp Phe Ala Glu Val Ile Asp
Asn Gly Gly Glu Gly Val Arg Arg Glu His Tyr Tyr Gly Leu Gly Tyr Gly Thr Gly Gly Ala Ala Asp
Ile Thr Glu Phe Arg Tyr Lys Gly Val Gly Asp Lys Phe Leu Gly Ser Gly Gly Gln Arg Leu Val Asp
Leu Lys Asn Phe Ser Ala Val Thr Trp Asn Leu Met Pro Ser Asp Lys Ala Val Val Phe Leu Glu Asn
His Asp Thr Gln Arg Gly Gly Gly Ile Gly Tyr Arg Asp Gly Thr Ala Phe Arg Leu Ala Asn Val Trp
Met Leu Ala Gln Pro Tyr Gly Tyr Pro Ser Val Met Ser Ser Tyr Ala Phe Asp Arg Thr Ser Pro Phe
Gly Arg Asp Ala Gly Pro Pro Ser Glu Asp Gly Ala Thr Lys Asp Val Thr Cys Ala Pro Thr Leu Glu
Thr Ala Val Leu Gly Thr Trp Val Cys Glu His Arg Asp Pro Val Ile Gln Arg Met Val Gly Phe Arg
Arg Ala Met Ala Gly Thr Asp Leu Asn Arg Trp Trp Asp Asn Gly Gly Asn Ala Ile Ala Phe Ser Arg
Gly Asp Arg Gly Phe Val Ala Ile Ser Arg Glu Pro Lys Val Thr Met Ala Ala Val Pro Ser Gly Leu
Ser Pro Gly Thr Tyr Cys Asp Val Leu Thr Gly Gly Lys Val Gly Asn Ala Cys Ala Gly Thr Ser Val
Thr Val Asp Ser Gln Gly Val Val Gln Leu Ser Ile Val Glu Asn Ser Ala Leu Val Ile His Leu Gly
Ala Lys Leu Arg Arg Ala Gly Gly Cys Ala Glu

FIGURE 16WW

SEQ ID NO: 123
atgccccaggccattcgcacttttcacgttggacgttgttcggcttaatcggcgtttttctgcttggtctcgtctttctgtcccaccccgggcaatcc
aggcccagacaaccccggcccgtaccgttatggttcacctcttcgagtggaaatggaccgacatcgctaaagaatgcgagaatttcctcggac
cgaaaggctttgccgcaatccaggtatcgccgccccaggagcatgtccaggggtcgcaatggtggacccgctatcagccggtcagctacaag
atcgagagccgctccggcacccgggccgagttcgccaatatggtctcgcgctgcaaagccgtcggggtcgatatctatgtcgatgccgtgatc
aaccatatgacgactgtcggctccggcactggtatggctggatcgacctacaccagctacacctatccggggctgtatcagacccaggacttcc
accactgcgggcgcaatggcaacgatgatatcagcagctacggcgatcgctgggaagtacaaaactgcgaactgctcaacctagccgacctc
aacaccggcgctgagtatgtccggggtaaactcgccgcctatatgaacgatctgcgcggcctgggcgtcgccggatttcggatcgatgccgcc
aagcacatggataccaacgacatcaacaatatcgttggccgcctgcccaacgcgccctacatctaccaggaagtgatcgaccagggcggcga
gccaattaccgccggcgaatacttccagaatggcgatgtgaccgagttcaagtacagccgcgagatctcgcgcatgttcaaaaccggccagct
gacccatatgagccagttcggcactgcctggggcttcatgtccagcgacctggcagtagttttcaccgataaccacgacaaccagcgcggtca
cggcggcgccggcgatgtcttgacctacaaagatggccagctgtacaccctgggcaatatcttcgagctagcctggccgtatggctacccaca
ggtcatgtcgagctacacgttcagcaacggcgaccaggggccgccatcgaccaatgtgtacgcaaccacaacgcctgattgtggcaacggcc
gctgggtctgtgagcaccgctggcgaggaatcgccaacatggtcgcgttccgcaactacaccgccccgaccttcagcaccagcaactggtgg
agcaacggcaacaaccagatcgctttcagccgcgggaccctgggctttgtggcgatcaatcgggaaggtggcagcctgaaccgcaccttcca
aaccggcctgcccgtcggcacctactgcgatgtcattcacggcgatttcaatgccagcgccggcacctgttccggcccaactatcgctgtcaac
ggctccggacaggcaaccatcacggtcaacgcgatggacgcggtggcgatctacggcggagccaggctcgccactccggccagtgtcaac
gtgacattcaacgaaaacgccacgaccacctgggggcagaatgtgtatatcgtcggcaacgtcgccgccctgggcagctggaacgcaggca
gcgcggtcttactctcctccgctaactacccaatctggagcaagaccatcgccctgccagccaacaccgccattgagtacaagtacatcaaaaa
ggatggcgcgggcaatgtggtgtgggaaagcggcgccaaccgcgtctttaccaccccggcagcggcagtgccacgcgcaacgatacctg
gaaatag SEQ ID NO: 124
Met Pro Gln Ala Ile Arg Thr Phe Ser Arg Trp Thr Leu Phe Gly Leu Ile Gly Val Phe Leu Leu Gly
Leu Val Phe Ser Val Pro Pro Arg Ala Ile Gln Ala Gln Thr Thr Pro Ala Arg Thr Val Met Val His
Leu Phe Glu Trp Lys Trp Thr Asp Ile Ala Lys Glu Cys Glu Asn Phe Leu Gly Pro Lys Gly Phe Ala
Ala Ile Gln Val Ser Pro Pro Gln Glu His Val Gln Gly Ser Gln Trp Trp Thr Arg Tyr Gln Pro Val Ser
Tyr Lys Ile Glu Ser Arg Ser Gly Thr Arg Ala Glu Phe Ala Asn Met Val Ser Arg Cys Lys Ala Val
Gly Val Asp Ile Tyr Val Asp Ala Val Ile Asn His Met Thr Thr Val Gly Ser Gly Thr Gly Met Ala
Gly Ser Thr Tyr Thr Ser Tyr Thr Tyr Pro Gly Leu Tyr Gln Thr Gln Asp Phe His His Cys Gly Arg
Asn Gly Asn Asp Asp Ile Ser Ser Tyr Gly Asp Arg Trp Glu Val Gln Asn Cys Glu Leu Leu Asn
Leu Ala Asp Leu Asn Thr Gly Ala Glu Tyr Val Arg Gly Lys Leu Ala Ala Tyr Met Asn Asp Leu
Arg Gly Leu Gly Val Ala Gly Phe Arg Ile Asp Ala Ala Lys His Met Asp Thr Asn Asp Ile Asn Asn
Ile Val Gly Arg Leu Pro Asn Ala Pro Tyr Ile Tyr Gln Glu Val Ile Asp Gln Gly Gly Glu Pro Ile Thr
Ala Gly Glu Tyr Phe Gln Asn Gly Asp Val Thr Glu Phe Lys Tyr Ser Arg Glu Ile Ser Arg Met Phe
Lys Thr Gly Gln Leu Thr His Met Ser Gln Phe Gly Thr Ala Trp Gly Phe Met Ser Ser Asp Leu Ala
Val Val Phe Thr Asp Asn His Asp Asn Gln Arg Gly His Gly Gly Ala Gly Asp Val Leu Thr Tyr
Lys Asp Gly Gln Leu Tyr Thr Leu Gly Asn Ile Phe Glu Leu Ala Trp Pro Tyr Gly Tyr Pro Gln Val
Met Ser Ser Tyr Thr Phe Ser Asn Gly Asp Gln Gly Pro Pro Ser Thr Asn Val Tyr Ala Thr Thr Thr
Pro Asp Cys Gly Asn Gly Arg Trp Val Cys Glu His Arg Trp Arg Gly Ile Ala Asn Met Val Ala Phe
Arg Asn Tyr Thr Ala Pro Thr Phe Ser Thr Ser Asn Trp Trp Ser Asn Gly Asn Asn Gln Ile Ala Phe
Ser Arg Gly Thr Leu Gly Phe Val Ala Ile Asn Arg Glu Gly Gly Ser Leu Asn Arg Thr Phe Gln Thr
Gly Leu Pro Val Gly Thr Tyr Cys Asp Val Ile His Gly Asp Phe Asn Ala Ser Ala Gly Thr Cys Ser
Gly Pro Thr Ile Ala Val Asn Gly Ser Gly Gln Ala Thr Ile Thr Val Asn Ala Met Asp Ala Val Ala Ile
Tyr Gly Gly Ala Arg Leu Ala Thr Pro Ala Ser Val Asn Val Thr Phe Asn Glu Asn Ala Thr Thr Thr
Trp Gly Gln Asn Val Tyr Ile Val Gly Asn Val Ala Ala Leu Gly Ser Trp Asn Ala Gly Ser Ala Val
Leu Leu Ser Ser Ala Asn Tyr Pro Ile Trp Ser Lys Thr Ile Ala Leu Pro Ala Asn Thr Ala Ile Glu Tyr
Lys Tyr Ile Lys Lys Asp Gly Ala Gly Asn Val Val Trp Glu Ser Gly Ala Asn Arg Val Phe Thr Thr
Pro Gly Ser Gly Ser Ala Thr Arg Asn Asp Thr Trp Lys

FIGURE 16XX

SEQ ID NO: 125 gtggtgcacatgaagttgaagtaccttgccttagttttgttggctgtggcttcgataggcctactctcgactccagtgggtgctgccaagtactccg
aactcgaagagggcggtgttataatgcaggccttctactgggatgttcccggagggggaatctggtgggacaccataagacagaaaatcccg
gagtggtacgacgctggaatctcggcgatatggattcctccagctagcaaagggatgggcggtggttattccatgggctacgatccctacgattt
ctttgacctcggcgagtactatcagaagggaacagttgagacgcgcttcggctcaaaggaggaactggtgaacatgataaacaccgcacactc
ctatggcataaaggtgatagcggacatagtcataaaccaccgcgccggtggagaccttgagtggaaccccttgtaaacaactatacttggaca
gacttctccaaggtcgcctccggtaaatacacggccaactaccttgacttccacccaaacgaggtcaagtgctgcgatgagggtacatttggtga
ctttccggacatcgcccacgagaagagctgggatcagtactggctctgggcaagcaatgagagctacgccgcatatctccggagcataggga
tcgatgcatggcgtttcgactacgtcaaaggttacggagcgtgggttgttaatgactggctcagctggtgtgggaggctgggccgttggagagta
ctgggacacgaacgttgatgcactccttaactgggcatacgacagcggtgccaaggtctttgacttcccgctctactacaagatggacgaagcc
tttgacaacaccaacatccccgctttggtttacgccctccagaacggaggaacagtcgtttccgcgatcccttcaaggcagtaactttcgttgcc
aaccacgatacagatataatctggaacaagtatccggcttatgcgttcatccttacctatgagggacagcctgttatattttaccgcgactacgagg
agtggctcaacaaggataagcttaacaaccttatctggatacacgagcaccttgccggaggaagtaccaagatcctctactacgataacgatga
gctaatattcatgagggagggctacgggagcaagccgggcctcataacctacataaacctcggaaacgactgggccgagcgctgggtgaac
gtcggctcaaagtttgccggctacacaatccatgaatacacaggcaatctcggtggctgggttgacaggtgggttcagtacgatggatgggtta
aactgacggcacctcctcatgatccagccaacggatattacggctactcagtctggagctacgcaggcgtcggatga SEQ ID NO: 126
Val Val His Met Lys Leu Lys Tyr Leu Ala Leu Val Leu Leu Ala Val Ala Ser Ile Gly Leu Leu Ser
Thr Pro Val Gly Ala Ala Lys Tyr Ser Glu Leu Glu Glu Gly Gly Val Ile Met Gln Ala Phe Tyr Trp
Asp Val Pro Gly Gly Gly Ile Trp Trp Asp Thr Ile Arg Gln Lys Ile Pro Glu Trp Tyr Asp Ala Gly Ile
Ser Ala Ile Trp Ile Pro Pro Ala Ser Lys Gly Met Gly Gly Gly Tyr Ser Met Gly Tyr Asp Pro Tyr
Asp Phe Phe Asp Leu Gly Glu Tyr Tyr Gln Lys Gly Thr Val Glu Thr Arg Phe Gly Ser Lys Glu Glu
Leu Val Asn Met Ile Asn Thr Ala His Ser Tyr Gly Ile Lys Val Ile Ala Asp Ile Val Ile Asn His Arg
Ala Gly Gly Asp Leu Glu Trp Asn Pro Phe Val Asn Asn Tyr Thr Trp Thr Asp Phe Ser Lys Val Ala
Ser Gly Lys Tyr Thr Ala Asn Tyr Leu Asp Phe His Pro Asn Glu Val Lys Cys Cys Asp Glu Gly Thr
Phe Gly Asp Phe Pro Asp Ile Ala His Glu Lys Ser Trp Asp Gln Tyr Trp Leu Trp Ala Ser Asn Glu
Ser Tyr Ala Ala Tyr Leu Arg Ser Ile Gly Ile Asp Ala Trp Arg Phe Asp Tyr Val Lys Gly Tyr Gly
Ala Trp Val Val Asn Asp Trp Leu Ser Trp Trp Gly Gly Trp Ala Val Gly Glu Tyr Trp Asp Thr Asn
Val Asp Ala Leu Leu Asn Trp Ala Tyr Asp Ser Gly Ala Lys Val Phe Asp Phe Pro Leu Tyr Tyr Lys
Met Asp Glu Ala Phe Asp Asn Thr Asn Ile Pro Ala Leu Val Tyr Ala Leu Gln Asn Gly Gly Thr Val
Val Ser Arg Asp Pro Phe Lys Ala Val Thr Phe Val Ala Asn His Asp Thr Asp Ile Ile Trp Asn Lys
Tyr Pro Ala Tyr Ala Phe Ile Leu Thr Tyr Glu Gly Gln Pro Val Ile Phe Tyr Arg Asp Tyr Glu Glu
Trp Leu Asn Lys Asp Lys Leu Asn Asn Leu Ile Trp Ile His Glu His Leu Ala Gly Gly Ser Thr Lys
Ile Leu Tyr Tyr Asp Asn Asp Glu Leu Ile Phe Met Arg Glu Gly Tyr Gly Ser Lys Pro Gly Leu Ile
Thr Tyr Ile Asn Leu Gly Asn Asp Trp Ala Glu Arg Trp Val Asn Val Gly Ser Lys Phe Ala Gly Tyr
Thr Ile His Glu Tyr Thr Gly Asn Leu Gly Gly Trp Val Asp Arg Trp Val Gln Tyr Asp Gly Trp Val
Lys Leu Thr Ala Pro Pro His Asp Pro Ala Asn Gly Tyr Tyr Gly Tyr Ser Val Trp Ser Tyr Ala Gly
Val Gly

SEQ ID NO: 127 gtgtgcatgaattatttgaaaaaagtgtggttgtattacgctatcgtcgctaccttaatcatttacttcttacgcccttttcaactgcacaagccaacac
tgcaccagtcaacggaacgatgatgcaatatttcgaatgggatttaccgaatgatggcacactttggacgaaagtaaaaaacgaagcaagcagt
ctttcttctttaggtattactgcgttatggttaccacctgcatacaaaggaacgagccaaggggatgtcgggtatggcgtgtacgatttgtatgactt
aggagaatttaatcaaaaagggacgattcgaacgaaatacggaacaaaaacgcaatatttacaagccattcaagcggcaaaaagcgctggcat
gcaagtatacgctgatgtcgtatttaatcacaaggcgggggcagatagtacagaatgggttgacgcagtcgaagtgaatccttctaatcgaaacc
aagaaacatctggcacatatcaaattcaagcatggacaaaatttgatttccctggccgtgggaacacatactcaagctttaaatggcgatggtatc
attttgacggtacggattgggatgaaagccgaaaactaaatcgtatttacaaatttcgtggcacaggaaaagcatgggattgggaagtagacaca
gagaacggaaactatgactacttaatgtttgctgatttagatatggatcaccctgaagtcgtgacagagctaaaaaactggggaacatggtacgtc

FIGURE 16YY aatacgacaaatgtcgatgggtttcgcttagatgcagtaaagcatatattaaatatagcttcttcccagattggttaacacatgtgcgttcacaaacacg
aaaaaatcttttgcagtaggagaattttggagctacgatgtcaataaactgcataactacattacaaaaacaagtggaaccatgtcgttatttgatg
cgccacttcataacaacttttacactgcttcaaaatctagcgggtattttgacatgcgctatttgttaaataatacgttgatgaaagaccagccttctct
tgcggtcacactcgttgataatcatgacacgcaaccgggacaatctttacaatcatgggtagagccttggtttaagccgcttgcttatgcctttatttt
gacaagacaagaaggatatccttgcgtattttacggcgactattacggcatccctaaatacaacattccgggattgaaaagtaaaatcgatccgct
tctcattgcccgtagagactacgcatacggaacacaacgtgattatattgaccatcaagacattattggatggacacgggaaggaattgactcaa
aaccgaactctggacttgcggcttttaattactgacggccctggtggaagtaaatggatgtatgtaggtaaaaagcatgctggaaaagtgttttacg
atctcactggaaatcgaagcgatacggtaacgattaatgcagacggctggggagagtttaaagtaaacggtggctccgtttccatttgggttgcc
aaaaacatcacaagtcacgtttaccgtcaacaatgcgacaacgataagcggacaaaatgtgtatgtcgttggtaacattccagagctcggaaattg
gaacacagcaaacgcaatcaaaatgacccatcttcttatccaacgtggaaagcaaccattgctcttccacaaggaaaagccattgaatttaaatt
tattaaaaaagaccaatcgggaaatgttgtttgggaaagcattccaaaccgaacatacaccgttccatttttatcaacaggctcatatacagctagtt
ggaatgtaccttaa SEQ ID NO: 128
Val Cys Met Asn Tyr Leu Lys Lys Val Trp Leu Tyr Tyr Ala Ile Val Ala Thr Leu Ile Ile Tyr Phe
Leu Thr Pro Phe Ser Thr Ala Gln Ala Asn Thr Ala Pro Val Asn Gly Thr Met Met Gln Tyr Phe Glu
Trp Asp Leu Pro Asn Asp Gly Thr Leu Trp Thr Lys Val Lys Asn Glu Ala Ser Ser Leu Ser Ser Leu
Gly Ile Thr Ala Leu Trp Leu Pro Pro Ala Tyr Lys Gly Thr Ser Gln Gly Asp Val Gly Tyr Gly Val
Tyr Asp Leu Tyr Asp Leu Gly Glu Phe Asn Gln Lys Gly Thr Ile Arg Thr Lys Tyr Gly Thr Lys Thr
Gln Tyr Leu Gln Ala Ile Gln Ala Ala Lys Ser Ala Gly Met Gln Val Tyr Ala Asp Val Val Phe Asn
His Lys Ala Gly Ala Asp Ser Thr Glu Trp Val Asp Ala Val Glu Val Asn Pro Ser Asn Arg Asn Gln
Glu Thr Ser Gly Thr Tyr Gln Ile Gln Ala Trp Thr Lys Phe Asp Phe Pro Gly Arg Gly Asn Thr Tyr
Ser Ser Phe Lys Trp Arg Trp Tyr His Phe Asp Gly Thr Asp Trp Asp Glu Ser Arg Lys Leu Asn Arg
Ile Tyr Lys Phe Arg Gly Thr Gly Lys Ala Trp Asp Trp Glu Val Asp Thr Glu Asn Gly Asn Tyr Asp
Tyr Leu Met Phe Ala Asp Leu Asp Met Asp His Pro Glu Val Val Thr Glu Leu Lys Asn Trp Gly
Thr Trp Tyr Val Asn Thr Thr Asn Val Asp Gly Phe Arg Leu Asp Ala Val Lys His Ile Lys Tyr Ser
Phe Phe Pro Asp Trp Leu Thr His Val Arg Ser Gln Thr Arg Lys Asn Leu Phe Ala Val Gly Glu Phe
Trp Ser Tyr Asp Val Asn Lys Leu His Asn Tyr Ile Thr Lys Thr Ser Gly Thr Met Ser Leu Phe Asp
Ala Pro Leu His Asn Asn Phe Tyr Thr Ala Ser Lys Ser Ser Gly Tyr Phe Asp Met Arg Tyr Leu Leu
Asn Asn Thr Leu Met Lys Asp Gln Pro Ser Leu Ala Val Thr Leu Val Asp Asn His Asp Thr Gln
Pro Gly Gln Ser Leu Gln Ser Trp Val Glu Pro Trp Phe Lys Pro Leu Ala Tyr Ala Phe Ile Leu Thr
Arg Gln Glu Gly Tyr Pro Cys Val Phe Tyr Gly Asp Tyr Gly Ile Pro Lys Tyr Asn Ile Pro Gly
Leu Lys Ser Lys Ile Asp Pro Leu Leu Ile Ala Arg Arg Asp Tyr Ala Tyr Gly Thr Gln Arg Asp Tyr
Ile Asp His Gln Asp Ile Ile Gly Trp Thr Arg Glu Gly Ile Asp Ser Lys Pro Asn Ser Gly Leu Ala Ala
Leu Ile Thr Asp Gly Pro Gly Gly Ser Lys Trp Met Tyr Val Gly Lys Lys His Ala Gly Lys Val Phe
Tyr Asp Leu Thr Gly Asn Arg Ser Asp Thr Val Thr Ile Asn Ala Asp Gly Trp Gly Glu Phe Lys Val
Asn Gly Gly Ser Val Ser Ile Trp Val Ala Lys Thr Ser Gln Val Thr Phe Thr Val Asn Asp Ala Thr
Thr Ile Ser Gly Gln Asn Val Tyr Val Val Gly Asn Ile Pro Glu Leu Gly Asn Trp Asn Thr Ala Asn
Ala Ile Lys Met Thr Pro Ser Ser Tyr Pro Thr Trp Lys Ala Thr Ile Ala Leu Pro Gln Gly Lys Ala Ile
Glu Phe Lys Phe Ile Lys Lys Asp Gln Ser Gly Asn Val Val Trp Glu Ser Ile Pro Asn Arg Thr Tyr
Thr Val Pro Phe Leu Ser Thr Gly Ser Tyr Thr Ala Ser Trp Asn Val Pro SEQ ID NO: 129
ttgcgttgccgccgtggcagggacgggtgttggtgcgggcggcgtaatgcgctgccgcgacacccgcgtgaacaaaataatatgaattatttg
aataggatgggggtgtcaagaatgacaaaatctcgagagttgcggtgttcatggaaagtatttgttgttgggtgcctgttgtggatggcttgggga
tcttccgcgtccgccggcgtattgatgcaaggcttctactgggacgccagtaccgggaccagtgattcgtggtggacgcatttggccaagcaag
ccaacggtctaaaacgggcggggttcaccgccgtatggattcctccggtgcttaaagggggcttcagggggctattccaacgggtacgatcccttt
tgacgactatgatatcggaagcaaggaccagaaaggtaccgtggcgacgcgatgggggacgcgagaagaactgcaacgtgccgtggccgt
gatgcgcgcgaacggtctggatgtgtatgtggatctggtgctgaaccaccgcaacggggacgacgggaattggaatttcattacaaagatgc
gtacggcaaagtgggttacgggcggttcaaaagggggtttacgattttcaccccaactacaacattcaggatgccaatgttcccaacgaggattc

FIGURE 16ZZ cagcttcgggcgcgatttagcccatgacaatccgtatgtggccgatggactgaaggctgcaggcgattggctgaccaaagccctcgatgttca
gggatatcgtctggattacgtgaaaggcatcagctacaccttcctgaaaagttatctgtcctatggggccatgaacggaaaatttgccgtcggtga
gtactgggatgccaaccgggatacgttgaactggtgggcgaacacggcgatggaagggcgggcccatgtgtttgattttgcgttgcgcgagg
agctgaaaaacatgtgcaatgcggacgggtactacgacatgcgtcgattggaccacgcgggtctggtcggaatcgacccgtggaaggcggt
gacgtttgtcgaaaaccatgatacggatcggcacgaccccatctacaataacaagcatttggcgtatgcctacatcttgacgtcggaagggtatc
cgacggtgttctggaaggattactaccaatacggaatgaagccgatcatcgacaacctcatttggatccacgaacacattgcgtacggaacgac
ccaagagcgttggaaagacgaagatgtctttgtgtatgagcggaccggaggcaagcggctattggtggggcttaacgacaatcgcgccacca
gcaaaacggtcaccgtacagaccggctttggtgccaacgtggccttgcacgactacaccggcaacggccccgatctccgtaccgacgcctac
ggtcgggtaaccttgaccattcctgcaaacgggtacgtggcctattccgttccgggcatctccggatccttgtgccggtcgagaaaaccgtgac
gcaggagtttgccggggcgtccgacttggatattcgtccggccgataacacgcaatttgtgcaggtcgggcggatatacgccaaggcaaacaa
gccggttacagcggaattgtattgggatgccaaagactggacgacctccacgtcgattctcctagaagtgcgttcggcttcgggaacgctcatc
acgacaaagaccgtgacccaattgtcgtcccagggtacccgcgtttccttcacgccttcggctaccggatggtacgtcttttccattcgaagctat
aacacgccttcgacgaacccaaagccggcctactggttaaaggtaacgtatacggcgccgcaattgcttcagtaa SEQ ID NO: 130
Met Arg Cys Arg Arg Gly Arg Asp Gly Cys Trp Cys Gly Arg Arg Asn Ala Leu Pro Arg His Pro
Arg Glu Gln Asn Asn Met Asn Tyr Leu Asn Arg Met Gly Val Ser Arg Met Thr Lys Ser Arg Glu
Leu Arg Cys Ser Trp Lys Val Phe Val Val Gly Cys Leu Leu Trp Met Ala Trp Gly Ser Ser Ala Ser
Ala Gly Val Leu Met Gln Gly Phe Tyr Trp Asp Ala Ser Thr Gly Thr Ser Asp Ser Trp Trp Thr His
Leu Ala Lys Gln Ala Asn Gly Leu Lys Arg Ala Gly Phe Thr Ala Val Trp Ile Pro Pro Val Leu Lys
Gly Ala Ser Gly Gly Tyr Ser Asn Gly Tyr Asp Pro Phe Asp Asp Tyr Asp Ile Gly Ser Lys Asp Gln
Lys Gly Thr Val Ala Thr Arg Trp Gly Thr Arg Glu Glu Leu Gln Arg Ala Val Ala Val Met Arg Ala
Asn Gly Leu Asp Val Tyr Val Asp Leu Val Leu Asn His Arg Asn Gly Asp Asp Gly Asn Trp Asn
Phe His Tyr Lys Asp Ala Tyr Gly Lys Val Gly Tyr Gly Arg Phe Gln Lys Gly Phe Tyr Asp Phe His
Pro Asn Tyr Asn Ile Gln Asp Ala Asn Val Pro Asn Glu Asp Ser Ser Phe Gly Arg Asp Leu Ala His
Asp Asn Pro Tyr Val Ala Asp Gly Leu Lys Ala Ala Gly Asp Trp Leu Thr Lys Ala Leu Asp Val
Gln Gly Tyr Arg Leu Asp Tyr Val Lys Gly Ile Ser Tyr Thr Phe Leu Lys Ser Tyr Leu Ser Tyr Gly
Ala Met Asn Gly Lys Phe Ala Val Gly Glu Tyr Trp Asp Ala Asn Arg Asp Thr Leu Asn Trp Trp
Ala Asn Thr Ala Met Glu Gly Arg Ala His Val Phe Asp Phe Ala Leu Arg Glu Glu Leu Lys Asn
Met Cys Asn Ala Asp Gly Tyr Tyr Asp Met Arg Arg Leu Asp His Ala Gly Leu Val Gly Ile Asp
Pro Trp Lys Ala Val Thr Phe Val Glu Asn His Asp Thr Asp Arg His Asp Pro Ile Tyr Asn Asn Lys
His Leu Ala Tyr Ala Tyr Ile Leu Thr Ser Glu Gly Tyr Pro Thr Val Phe Trp Lys Asp Tyr Tyr Gln
Tyr Gly Met Lys Pro Ile Ile Asp Asn Leu Ile Trp Ile His Glu His Ile Ala Tyr Gly Thr Thr Gln Glu
Arg Trp Lys Asp Glu Asp Val Phe Val Tyr Glu Arg Thr Gly Gly Lys Arg Leu Leu Val Gly Leu
Asn Asp Asn Arg Ala Thr Ser Lys Thr Val Thr Val Gln Thr Gly Phe Gly Ala Asn Val Ala Leu His
Asp Tyr Thr Gly Asn Gly Pro Asp Leu Arg Thr Asp Ala Tyr Gly Arg Val Thr Leu Thr Ile Pro Ala
Asn Gly Tyr Val Ala Tyr Ser Val Pro Gly Ile Ser Gly Ser Phe Val Pro Val Gln Lys Thr Val Thr
Gln Glu Phe Ala Gly Ala Ser Asp Leu Asp Ile Arg Pro Ala Asp Asn Thr Gln Phe Val Gln Val Gly
Arg Ile Tyr Ala Lys Ala Asn Lys Pro Val Thr Ala Glu Leu Tyr Trp Asp Ala Lys Asp Trp Thr Thr
Ser Thr Ser Ile Leu Leu Glu Val Arg Ser Ala Ser Gly Thr Leu Ile Thr Thr Lys Thr Val Thr Gln Leu
Ser Ser Gln Gly Thr Arg Val Ser Phe Thr Pro Ser Ala Thr Gly Trp Tyr Val Phe Ser Ile Arg Ser Tyr
Asn Thr Pro Ser Thr Asn Pro Lys Pro Ala Tyr Trp Leu Lys Val Thr Tyr Thr Ala Pro Gln Leu Leu
Gln SEQ ID NO: 131
atgccgcagctttacccattgccgccgcgctggcggcgcgcggcccggcagggcctggccgccttgacgctggccaccacggccctgggc
atctcgacggcccaggcccagagtgcaccgcgcacggccttcgtgcatctgttcgaatggaagtggaccgacatcgcgcgcgagtgcgaga
ccttcctcgggcccaagggcttcgcggcggtgcaggtgtcgcccccgaacgagcacaactgggtgaccagcggtgatggtgcaccttatccg
tggtggatgcgctaccagccggtgagctacagcctggaccgcagccgcagcggcacgcgcgccgagttccaggacatggtcaaccgatgc
aatgccgtgggcgtgggcatctacgtggacgccgtgatcaatcacatgtccggcggcacgggcggcacctcgagcgctggggcgcagctgg

FIGURE 16AAA agctatcacaactaccctgggctctatggccccaacgacttccaccagccggtgtgcagcatcaccaactacggggatgcgaacaatgtgcag
cgttgcgagctctcgggcttgcaggacctggacactgggagcgcttatgtgcgcggcaagatcgccgactatctggtggatctggtcaacatg
ggggtcaagggcttccgggtggatgcggccaagcacatcagcccgaccgacctgggcgccatcatcgatgcggtcaacagccgcaccggc
gcgaaccgcccttctggtttctggaggtgattggcgcggccggcgaggcagtgcagccgaaccagtacttctcgctcggcggcggccaggt
caccgtgaccgagttcaactatggaagcaaatcttcggcaagttcgccggtggcggccgtctggccgagctgcgcagcttcggtgaaacctg
gggcctgatgcccagcagcaaagcgattgctttcatcgacaaccacgacaagcagcgcggtcatggcggcggtggcaactatctgacctacc
accatggctcgacctacgatctggccaacatcttcatgctggcttggcctattggctacccggcgctgatgtccagctatgccttcaaccgcagc
acggcctacgacacgagctttggcccgccacacgacagtggtggcgccacccgtggcccctgggatggtggcggcagccagccggcctgc
ttcaaccagagcatcggtggctgggtgtgtgagcaccgctggcggggcatcgccaatatggtggccttccgcaacgccacgctgcccaactg
gaccgtgaccgactggtgggacaacggcaacaaccagatcgctttcgggcggggtgacaagggcttcgtggtgatcaaccgcgaagacgc
cgcgctgacgcgcaacttcaagaccagcctgccagccggccagtactgcgatgtcatctccggggacttcaacaatggtcagtgcacgggcc
atgtggtgacggtcgatgccggcggctacgtgacgctgacggccgggcccaatggtgcggcggccatccacgtgggcgcccgtctggacg
gcgcctctcagccgccgacgaccgcctcggtgacgttcaacgcgtcggccgatacctttggggacagaacctgttcgtcgtgggcaaccaca
gcgcactgggcaactggtcgccggcggccgccaggccgatgacttggatttccggttcgggcacgcgcgggaactggcgcgcggtgctca
atttgccggccaataccacctaccaatacaagttcatcaagaaggacggggctggaaacgtggtttgggagggcggtggcaatcgcgtcgtga
ccacgccgtctgggggcggatcggtgagcacgggcggcaattggcagtag SEQ ID NO: 132
Met Pro Gln Leu Tyr Pro Leu Pro Pro Arg Trp Arg Arg Ala Ala Arg Gln Gly Leu Ala Ala Leu Thr
Leu Ala Thr Thr Ala Leu Gly Ile Ser Thr Ala Gln Ala Gln Ser Ala Pro Arg Thr Ala Phe Val His
Leu Phe Glu Trp Lys Trp Thr Asp Ile Ala Arg Glu Cys Glu Thr Phe Leu Gly Pro Lys Gly Phe Ala
Ala Val Gln Val Ser Pro Pro Asn Glu His Asn Trp Val Thr Ser Gly Asp Gly Ala Pro Tyr Pro Trp
Trp Met Arg Tyr Gln Pro Val Ser Tyr Ser Leu Asp Arg Ser Arg Ser Gly Thr Arg Ala Glu Phe Gln
Asp Met Val Asn Arg Cys Asn Ala Val Gly Val Gly Ile Tyr Val Asp Ala Val Ile Asn His Met Ser
Gly Gly Thr Gly Gly Thr Ser Ser Ala Gly Arg Ser Trp Ser Tyr His Asn Tyr Pro Gly Leu Tyr Gly
Pro Asn Asp Phe His Gln Pro Val Cys Ser Ile Thr Asn Tyr Gly Asp Ala Asn Asn Val Gln Arg Cys
Glu Leu Ser Gly Leu Gln Asp Leu Asp Thr Gly Ser Ala Tyr Val Arg Gly Lys Ile Ala Asp Tyr Leu
Val Asp Leu Val Asn Met Gly Val Lys Gly Phe Arg Val Asp Ala Ala Lys His Ile Ser Pro Thr Asp
Leu Gly Ala Ile Ile Asp Ala Val Asn Ser Arg Thr Gly Ala Asn Arg Pro Phe Trp Phe Leu Glu Val
Ile Gly Ala Ala Gly Glu Ala Val Gln Pro Asn Gln Tyr Phe Ser Leu Gly Gly Gly Gln Val Thr Val
Thr Glu Phe Asn Tyr Gly Lys Gln Ile Phe Gly Lys Phe Ala Gly Gly Gly Arg Leu Ala Glu Leu Arg
Ser Phe Gly Glu Thr Trp Gly Leu Met Pro Ser Ser Lys Ala Ile Ala Phe Ile Asp Asn His Asp Lys
Gln Arg Gly His Gly Gly Gly Asn Tyr Leu Thr Tyr His His Gly Ser Thr Tyr Asp Leu Ala Asn
Ile Phe Met Leu Ala Trp Pro Tyr Gly Tyr Pro Ala Leu Met Ser Ser Tyr Ala Phe Asn Arg Ser Thr
Ala Tyr Asp Thr Ser Phe Gly Pro Pro His Asp Ser Gly Gly Ala Thr Arg Gly Pro Trp Asp Gly Gly
Gly Ser Gln Pro Ala Cys Phe Asn Gln Ser Ile Gly Gly Trp Val Cys Glu His Arg Trp Arg Gly Ile
Ala Asn Met Val Ala Phe Arg Asn Ala Thr Leu Pro Asn Trp Thr Val Thr Asp Trp Trp Asp Asn
Gly Asn Asn Gln Ile Ala Phe Gly Arg Gly Asp Lys Gly Phe Val Val Ile Asn Arg Glu Asp Ala Ala
Leu Thr Arg Asn Phe Lys Thr Ser Leu Pro Ala Gly Gln Tyr Cys Asp Val Ile Ser Gly Asp Phe Asn
Asn Gly Gln Cys Thr Gly His Val Val Thr Val Asp Ala Gly Gly Tyr Val Thr Leu Thr Ala Gly Pro
Asn Gly Ala Ala Ala Ile His Val Gly Ala Arg Leu Asp Gly Ala Ser Gln Pro Pro Thr Thr Ala Ser
Val Thr Phe Asn Ala Ser Ala Asp Thr Phe Trp Gly Gln Asn Leu Phe Val Val Gly Asn His Ser Ala
Leu Gly Asn Trp Ser Pro Ala Ala Ala Arg Pro Met Thr Trp Ile Ser Gly Ser Gly Thr Arg Gly Asn
Trp Arg Ala Val Leu Asn Leu Pro Ala Asn Thr Thr Tyr Gln Tyr Lys Phe Ile Lys Lys Asp Gly Ala
Gly Asn Val Val Trp Glu Gly Gly Asn Arg Val Val Thr Thr Pro Ser Gly Gly Gly Ser Val Ser
Thr Gly Gly Asn Trp Gln SEQ ID NO: 133
atgaataatgtgaaaaaagtatggttgtattattctataattgctaccttagttatttccttttcacacctttttcaacagcacaagctaatactgcacctg
tcaacggaacaatgatgcaatatttcgaatgggatttaccgaatgatgggacgctttggacgaaagtaaaaatgaagctaccaatcttcttcgct

FIGURE 16BBB aggtattacagcgttatggctccctccagcatataaaggaacgagccaaagcgatgtcggatatggcgtgtacgatttatatgaccttggggaatt
taatcaaaaagggacgatccgaacgaaatacggaacaaaagcacaatatattcaagccatccaagctgccaaagccgcagggatgcaagtat
atgcagatgttgtatttaatcataaggcggggcgctgacggcacagaatttgtcgatgcagttgaggtaaaccctctaatcgaaatcaagaaacat
ctggcacatatcaaattcaagcatggacaaaatttgattttcctggtcgtggaaacacatactccagcttcaaatggcgctggtatcatttttgacggt
accgattgggatgaaagtcgtaaattaaatcgtatttacaaattccgcggtacaggaaaagcgtgggactgggaagtcgatacagaaaacgga
aactatgattatttaatgttcgctgatttagatatggatcaccctgaagttgtgacagagttaaaaaactggggaaaatggtatgtaaatacgacaaa
tgtagacggatttcgtttggatgccgtaaaacatattaaatacagcttttcctgactggctaacatatgtacgtaatcaaacaggaaaaaatttattt
gctgttggggaattttggagctatgacgtcaataagctgcataactacattacaaaaacaaatggatcgatgtcgttatttgatgcacctttgcataa
caactttatatcgcttccaaatcgagtggatattttgacatgcgttatttattgaataatacattaatgaaagatcaaccttcactcgctgtaacacttgt
cgataaccatgatacacaaccaggtcaatctttacaatcatgggtagaagcttggtttaaaccgcttgcttacgcctttatttttaacaagacaagag
gggtatccttgcgtatttacggtgactattacggaatcccgaaatacaatattccgggattaaaaagtaaaattgatccgctttaattgctcgtcgt
gattatgcttatggaacacaacgtgattacattgatcatcaagacatatcggatggacacgagaaggcattgatgcaaaaccgaactctggactt
gcggctttaattaccgacggccctggcggaagtaaatggatgtatgtcggtaaaaaacatgctgggaaagtgttttatgatttaactggaaatcga
agtgacacagtaacgattaatgcggacggttggggagaatttaaagtaaacggcggctccgtttcgatttgggtggctaaaacatcaaacgtca
catttacagtcaataacgccacaacaacaagtggacaaaacgtatatgttgttggcaacattccagagctaggcaattctttg SEQ ID NO: 134
Met Asn Asn Val Lys Lys Val Trp Leu Tyr Tyr Ser Ile Ile Ala Thr Leu Val Ile Ser Phe Phe Thr Pro
Phe Ser Thr Ala Gln Ala Asn Thr Ala Pro Val Asn Gly Thr Met Met Gln Tyr Phe Glu Trp Asp Leu
Pro Asn Asp Gly Thr Leu Trp Thr Lys Val Lys Asn Glu Ala Thr Asn Leu Ser Ser Leu Gly Ile Thr
Ala Leu Trp Leu Pro Pro Ala Tyr Lys Gly Thr Ser Gln Ser Asp Val Gly Tyr Gly Val Tyr Asp Leu
Tyr Asp Leu Gly Glu Phe Asn Gln Lys Gly Thr Ile Arg Thr Lys Tyr Gly Thr Lys Ala Gln Tyr Ile
Gln Ala Ile Gln Ala Ala Lys Ala Ala Gly Met Gln Val Tyr Ala Asp Val Val Phe Asn His Lys Ala
Gly Ala Asp Gly Thr Glu Phe Val Asp Ala Val Glu Val Asn Pro Ser Asn Arg Asn Gln Glu Thr Ser
Gly Thr Tyr Gln Ile Gln Ala Trp Thr Lys Phe Asp Phe Pro Gly Arg Gly Asn Thr Tyr Ser Ser Phe
Lys Trp Arg Trp Tyr His Phe Asp Gly Thr Asp Trp Asp Glu Ser Arg Lys Leu Asn Arg Ile Tyr Lys
Phe Arg Gly Thr Gly Lys Ala Trp Asp Trp Glu Val Asp Thr Glu Asn Gly Asn Tyr Asp Tyr Leu
Met Phe Ala Asp Leu Asp Met Asp His Pro Glu Val Val Thr Glu Leu Lys Asn Trp Gly Lys Trp
Tyr Val Asn Thr Thr Asn Val Asp Gly Phe Arg Leu Asp Ala Val Lys His Ile Lys Tyr Ser Phe Phe
Pro Asp Trp Leu Thr Tyr Val Arg Asn Gln Thr Gly Lys Asn Leu Phe Ala Val Gly Glu Phe Trp Ser
Tyr Asp Val Asn Lys Leu His Asn Tyr Ile Thr Lys Thr Asn Gly Ser Met Ser Leu Phe Asp Ala Pro
Leu His Asn Asn Phe Tyr Ile Ala Ser Lys Ser Ser Gly Tyr Phe Asp Met Arg Tyr Leu Leu Asn Asn
Thr Leu Met Lys Asp Gln Pro Ser Leu Ala Val Thr Leu Val Asp Asn His Asp Thr Gln Pro Gly Gln
Ser Leu Gln Ser Trp Val Glu Ala Trp Phe Lys Pro Leu Ala Tyr Ala Phe Ile Leu Thr Arg Gln Glu
Gly Tyr Pro Cys Val Phe Tyr Gly Asp Tyr Tyr Gly Ile Pro Lys Tyr Asn Ile Pro Gly Leu Lys Ser
Lys Ile Asp Pro Leu Leu Ile Ala Arg Arg Asp Tyr Ala Tyr Gly Thr Gln Arg Asp Tyr Ile Asp His
Gln Asp Ile Ile Gly Trp Thr Arg Glu Gly Ile Asp Ala Lys Pro Asn Ser Gly Leu Ala Ala Leu Ile Thr
Asp Gly Pro Gly Gly Ser Lys Trp Met Tyr Val Gly Lys Lys His Ala Gly Lys Val Phe Tyr Asp Leu
Thr Gly Asn Arg Ser Asp Thr Val Thr Ile Asn Ala Asp Gly Trp Gly Glu Phe Lys Val Asn Gly Gly
Ser Val Ser Ile Trp Val Ala Lys Thr Ser Asn Val Thr Phe Thr Val Asn Asn Ala Thr Thr Thr Ser
Gly Gln Asn Val Tyr Val Val Gly Asn Ile Pro Glu Leu Gly Asn Ser Leu SEQ ID NO: 135
gtgacaggcaccccgtctttatacattcctccacataaaataaccatacagctttcaaatttgttgaaatgtataaaaataaaaaatagtattgtaagc
gttaacatccgtcattataataacttcaaacgcgtttatgttttaatgcaaacgtttgcatcctcatttatttaaagaaaggatgtgtgtgcatgaattatt
tgaaaaaagtgtggttgtattacgctatcgtcgctaccttaatcatttcctttcttacgccctttcaactgcacaagccaacactgcaccagtcaacg
gaacgatgatgcaatatttcgaatgggatttaccgaatgatggcacactttggacgaaagtaaaaaacgaagcaagcagcctttcttctttaggtat
tactgcgttatggttaccacctgcatacaaaggaacgagccaaggggatgtcgggtatggcgtgtacgatttgtatgacttaggagaatttaatca
aaaagggacgattcgaacgaaatacggaacaaaaacgcaatatttacaagccattcaagcggcaaaaagcgctggcatgcaagtatacgctg
atgtcgtatttaatcacaaggcggggcagatagtacagaatgggttgacgcagtcgaagtgaatccttctaatcgaaaccaagaaacatctgg

FIGURE 16CCC cacatatcaaattcaagcatggacaaaatttgatttccctgaccgtgggaacacatactcaagctttaaatggcgctggtatcattttgacggtacg
gattgggatgaaagtcgaaaactaaatcgcatttacaaatttcgtggcacaggaaaagcatgggattgggaagtagacacagagaacggaaac
tatgactacttaatgtttgctgatttagatatggatcaccctgaagtcgtgacagagctaaaaaaactggggaacatggtacgtcaatacgacaaatg
tcgatgggtttcgcttagatgcagtaaagcatattaaatatagcttttccagattggttaacatatgtgcgctcacaaacacaaaaaaatctgtttg
cagtaggagaatttggagctacgatgtcaataaactgcataactacattacaaaaacaagtggaaccatgtcgttatttgatgcgccacttcataa
caacttttacactgcttcaaaatctagcgggtattttgacatgcgctatttgttaaataatacgttgatgaaagaccagccttctcttgcggtcacactc
gttgataatcatgacacgcaaccgggacaatctttacaatcatgggtagagccttggtttaagccgcttgcttatgcctttattttgacaagacaaga
aggatatccttgcgtattttacggcgactattacggcatccctaaatacaatattccgggattgaaaagtaaaatcgatccgcttctcattgcccgta
gagactacgcatacggaacacaacgtgattatattgaccatcaagacattattggatggacacgggaaggaattgactcaaaaccgaactctgg
acttgcggctttaattactgacggtcctggtggaagtaaatggatgtatgtaggtaaaaagcatgctggaaaagtgttttacgatctcactggaaat
cgaagcgatacggtaacgattaatgcagacggctggggagagtttaaagtaaacggtggctccgtttccatttgggttgccaaaacatcacaag
tcacgtttaccgtcaacaatgcgacaacgacaagcggacaaaatgtgtatgtcgttggcaacattccagagctcggaaattggaacacagcaaa
cgcaatcaaaatgaccccatcttcttatccaacgtggaaaacaaccattgctcttccacaaggaaaagcaattggcggcgtacgccatggcccttga SEQ ID NO: 136
Val Thr Gly Thr Pro Ser Leu Tyr Ile Pro Pro His Lys Ile Thr Ile Gln Leu Ser Asn Leu Leu Lys Cys
Ile Lys Ile Lys Asn Ser Ile Val Ser Val Asn Ile Arg His Tyr Asn Asn Phe Lys Arg Val Tyr Val Leu
Met Gln Thr Phe Ala Ser Ser Phe Tyr Leu Lys Lys Gly Cys Val Cys Met Asn Tyr Leu Lys Lys Val
Trp Leu Tyr Tyr Ala Ile Val Ala Thr Leu Ile Ile Ser Phe Leu Thr Pro Phe Ser Thr Ala Gln Ala Asn
Thr Ala Pro Val Asn Gly Thr Met Met Gln Tyr Phe Glu Trp Asp Leu Pro Asn Asp Gly Thr Leu
Trp Thr Lys Val Lys Asn Glu Ala Ser Ser Leu Ser Ser Leu Gly Ile Thr Ala Leu Trp Leu Pro Pro
Ala Tyr Lys Gly Thr Ser Gln Gly Asp Val Gly Tyr Gly Val Tyr Asp Leu Tyr Asp Leu Gly Glu Phe
Asn Gln Lys Gly Thr Ile Arg Thr Lys Tyr Gly Thr Lys Thr Gln Tyr Leu Gln Ala Ile Gln Ala Ala
Lys Ser Ala Gly Met Gln Val Tyr Ala Asp Val Val Phe Asn His Lys Ala Gly Ala Asp Ser Thr Glu
Trp Val Asp Ala Val Glu Val Asn Pro Ser Asn Arg Asn Gln Glu Thr Ser Gly Thr Tyr Gln Ile Gln
Ala Trp Thr Lys Phe Asp Phe Pro Asp Arg Gly Asn Thr Tyr Ser Ser Phe Lys Trp Arg Trp Tyr His
Phe Asp Gly Thr Asp Trp Asp Glu Ser Arg Lys Leu Asn Arg Ile Tyr Lys Phe Arg Gly Thr Gly Lys
Ala Trp Asp Trp Glu Val Asp Thr Glu Asn Gly Asn Tyr Asp Tyr Leu Met Phe Ala Asp Leu Asp
Met Asp His Pro Glu Val Val Thr Glu Leu Lys Asn Trp Gly Thr Trp Tyr Val Asn Thr Thr Asn Val
Asp Gly Phe Arg Leu Asp Ala Val Lys His Ile Lys Tyr Ser Phe Phe Pro Asp Trp Leu Thr Tyr Val
Arg Ser Gln Thr Gln Lys Asn Leu Phe Ala Val Gly Glu Phe Trp Ser Tyr Asp Val Asn Lys Leu His
Asn Tyr Ile Thr Lys Thr Ser Gly Thr Met Ser Leu Phe Asp Ala Pro Leu His Asn Asn Phe Tyr Thr
Ala Ser Lys Ser Ser Gly Tyr Phe Asp Met Arg Tyr Leu Leu Asn Asn Thr Leu Met Lys Asp Gln
Pro Ser Leu Ala Val Thr Leu Val Asp Asn His Asp Thr Gln Pro Gly Gln Ser Leu Gln Ser Trp Val
Glu Pro Trp Phe Lys Pro Leu Ala Tyr Ala Phe Ile Leu Thr Arg Gln Glu Gly Tyr Pro Cys Val Phe
Tyr Gly Asp Tyr Gly Ile Pro Lys Tyr Asn Ile Pro Gly Leu Lys Ser Lys Ile Asp Pro Leu Leu Ile
Ala Arg Arg Asp Tyr Ala Tyr Gly Thr Gln Arg Asp Tyr Ile Asp His Gln Asp Ile Ile Gly Trp Thr
Arg Glu Gly Ile Asp Ser Lys Pro Asn Ser Gly Leu Ala Ala Leu Ile Thr Asp Gly Pro Gly Gly Ser
Lys Trp Met Tyr Val Gly Lys Lys His Ala Gly Lys Val Phe Tyr Asp Leu Thr Gly Asn Arg Ser Asp
Thr Val Thr Ile Asn Ala Asp Gly Trp Gly Glu Phe Lys Val Asn Gly Gly Ser Val Ser Ile Trp Val
Ala Lys Thr Ser Gln Val Thr Phe Thr Val Asn Asn Ala Thr Thr Thr Ser Gly Gln Asn Val Tyr Val
Val Gly Asn Ile Pro Glu Leu Gly Asn Trp Asn Thr Ala Asn Ala Ile Lys Met Thr Pro Ser Ser Tyr
Pro Thr Trp Lys Thr Thr Ile Ala Leu Pro Gln Gly Lys Ala Ile Gly Gly Val Arg His Gly Pro SEQ ID NO: 137
gtgggacgggcaggcttggcgcatcactcgaacacttccgccaaggggacatacgggtcacctctcgaactgcgtccggatcgccccgccgt
ggccggggcggtcgagcttgaagatgtccagcggggagccgccgccgaggatcaccccggcggcgtactcgcccagggcggggctcag
cttgaagccgtggccggagccgcctccaggagccagacgttggaggcccgcggatggcggtcgaggaggaggtggccgtcgaggctgt
tctcgtactggcagacgcgggtctcgaccagcggcgcgtccttcagggccgggaaccggcggggccacctcggcccgggccgcttccagca

FIGURE 16DDD gggccggggtgatcgtccgctcgcccgccgtgggatcgatgggctcgccccgggtgtcgtccgccaccttgaagccgcggtgctcgttgcc
ggggatgccgtagtagatccgctcgccgagatcgacccagaccggacagccgccctcctggaagcgcgggtcgcccggcggcgtgccga
agaagaacacctcctggcgggtgttgcggaggaaccgctcaccgatcacgtccgggaacagcccggccagccagggaccgcaggcgaag
acgtagaggtcggccgcgagagtggagccgtccgaaaggtgaagccgctccaagggccccgggaccatggcggcctgccggtactcccc
gccctcgccctggaacagctccaccacggtccggcaggcgcgccgggcgaacagggcgccggcttcctcctcgtaccagatcgtgcggac
gccgtcgaaatcgacctgggggaagcggctccgggcctcccccctgagacagctcggcgaccggcagccccgcgtcctccagaaaaggaa
gggagtcgcggacgtagctgtcgtcctcgccgcacatccagaggaccccggtcctttgtacagccggtaaccggactggacttcggcgtccc
gccagagctcgaaggagcgggcgacccactccacgtacagacggtcgggtccgtaggcgccgcggatgatccgcgtctcgccaccggag
ctggagcgggagtgccccggaccccaggcgtccaggagggtcaccc ggg ctccgcggcggaggagatgcagggcggtccagccgccg
aaggcgccggcgccgacgacggcgatatgggatgggagggcatggcgggcgtaaggttatcgcagcccgatccttcgctggcatcccat
ctccgaccggagtatcctggaaaattcgaagaaggagatcgacatgcaatcgaacggaaacgtga SEQ ID NO: 138
Val Gly Arg Ala Gly Leu Ala His His Ser Asn Thr Ser Ala Lys Gly Thr Tyr Gly Ser Pro Leu Glu
Leu Arg Pro Asp Arg Pro Ala Val Ala Gly Ala Val Glu Leu Glu Asp Val Gln Arg Gly Ala Ala Ala
Glu Asp His Pro Gly Gly Val Leu Ala Gln Gly Gly Ala Gln Leu Glu Ala Val Ala Gly Ala Ala Ser
Gln Glu Pro Asp Val Gly Gly Pro Arg Met Ala Val Glu Glu Glu Val Ala Val Gly Ala Val Leu Val
Leu Ala Asp Ala Gly Leu Asp Gln Arg Arg Val Leu Gln Gly Arg Glu Pro Ala Gly His Leu Gly
Pro Gly Arg Phe Gln Gln Gly Arg Gly Asp Arg Pro Leu Ala Arg Arg Gly Ile Asp Gly Leu Ala Pro
Gly Val Val Arg His Leu Glu Ala Ala Val Leu Val Ala Gly Asp Ala Val Val Asp Pro Leu Ala Glu
Ile Asp Pro Asp Arg Thr Ala Ala Leu Leu Glu Ala Arg Val Ala Arg Arg Arg Ala Glu Glu Glu His
Leu Leu Ala Gly Val Ala Glu Glu Pro Leu Thr Asp His Val Arg Glu Gln Pro Gly Gln Pro Gly Thr
Ala Gly Glu Asp Val Glu Val Gly Arg Glu Ser Gly Ala Val Arg Lys Val Lys Pro Leu Gln Gly Pro
Arg Asp His Gly Gly Leu Pro Val Leu Pro Ala Leu Ala Leu Glu Gln Leu His His Gly Pro Ala Gly
Ala Pro Gly Glu Gln Gly Ala Gly Phe Leu Leu Val Pro Asp Arg Ala Asp Ala Val Glu Ile Asp Leu
Gly Glu Ala Ala Pro Gly Leu Pro Leu Arg Gln Leu Gly Asp Arg Gln Pro Arg Val Leu Gln Lys
Arg Lys Gly Val Ala Asp Val Ala Val Val Leu Ala Ala His Pro Glu Asp Pro Gly Pro Phe Val Gln
Pro Val Thr Gly Leu Asp Phe Gly Val Pro Pro Glu Leu Glu Gly Ala Gly Asp Pro Leu His Val Gln
Thr Val Gly Ser Val Gly Ala Ala Asp Asp Pro Arg Leu Ala Thr Gly Ala Gly Ala Gly Val Pro Arg
Thr Pro Gly Val Gln Glu Gly His Pro Gly Ser Ala Ala Glu Glu Met Gln Gly Gly Pro Ala Ala Glu
Gly Ala Gly Ala Asp Asp Gly Asp Met Gly Met Gly Gly His Gly Gly Arg Lys Val Ile Ala Ala Arg
Ser Phe Ala Gly Ile Pro Ser Pro Thr Gly Val Ser Trp Lys Ile Arg Arg Arg Arg Ser Thr Cys Asn
Arg Thr Glu Thr SEQ ID NO: 139
atgaaaacattcaaccttaaacccacacttttaccttta acttt gctgct gagttcgccggtattggcggcacaaaatggaactatgatgcagtattc
cattggtattgtgccaaatgaccacgccactctggaacaaagttgaaaacaatgagccagcactatccgaaaagggtttacagagctgtagttga
caccagatattaaaggcgcaggtgatagcaaacgaacgttggttacggtgtttatgatatgtatgacttagcggcgagtttgatcaaaaaggatcggta
cgaactaagtacggcaccaaagaccaatatctaaatgccatcaaagcagcacacaaaaacaatatccaaatttatggtgacgtagtgttcaacca
tcgtggcggtgcagatggcaagtcgtgggtcgataccaagcgtgtggattggaataaccgcaatattgaacttggcgataaatggattgaagca
tgggttgaatttagcttcccaggacgtaacgataaatactcagacttccattggacgtggtatcactttgatggcgtcgattgggatgacgcaggta
aagagaaagcgatctttaaattcaaaggtgatggtaaagcatgggattgggaagtcagttctgaaaaaggcaactatgactacctcatgtacgca
gacttagacatggatcacccagaagtgaagcaagagctgaaagattgggggtgaatggtacttaaacatgacgggtgttgatggcttccgaatgg
atgcagtgaaacacatcaaatatcagtacctacaagagtggatcgattacttgcgtaagaaaacgggcaaagagctctttaccgttggtgagtac
tggaactacgacgtgaacaatctgcacaacttatgactaagacttctggcagcatgtcattgtttgatgcgccttttacatatgaacttctataacgct
tcacgctctggtggcaactttgatatgcgccgaatcatggatggcaccttgatgaaagacaaacccagtgaaagcagtaacactggttgagaacc
atgatacgcaaccactacaggcc ttagagtctccggtggattggtggttcaaaccacttgcgtacgcgttcattttgcttcgtgaggaaggttatcc
gtcagtcttctacgcagattactacggtgcgcaatacagcgataaagggcacgatatcaacatggtgaaagtgccttacattgagcaattggtga
aagcgcgtaaagattatgcttatggtaaacaacattcttacctttgaccactgggatgtgattggttggacacgagaaggggggatgcggaacatccg

FIGURE 16EEE aactctatggcggttatcatgagtgatggtcctggcggaacaaagtggatgtacacaggttcaccgagcacacgttatgtcgataaactaggtatt
cgtaccgaagaagtatggactaacgctagtggatgggccgaattcccagtgaacggcggatcggtttctgtttgggttggcgttaaataa SEQ ID NO: 140
Met Lys Thr Phe Asn Leu Lys Pro Thr Leu Leu Pro Leu Thr Leu Leu Leu Ser Ser Pro Val Leu Ala
Ala Gln Asn Gly Thr Met Met Gln Tyr Phe His Trp Tyr Val Pro Asn Asp Gly Ala Leu Trp Thr Gln
Val Glu Asn Asn Ala Pro Ala Leu Ser Asp Asn Gly Phe Thr Ala Leu Trp Leu Pro Pro Ala Tyr Lys
Gly Ala Gly Gly Ser Asn Asp Val Gly Tyr Gly Val Tyr Asp Met Tyr Asp Leu Gly Glu Phe Asp
Gln Lys Gly Ser Val Arg Thr Lys Tyr Gly Thr Lys Asp Gln Tyr Leu Asn Ala Ile Lys Ala Ala His
Lys Asn Asn Ile Gln Ile Tyr Gly Asp Val Val Phe Asn His Arg Gly Gly Ala Asp Gly Lys Ser Trp
Val Asp Thr Lys Arg Val Asp Trp Asn Asn Arg Asn Ile Glu Leu Gly Asp Lys Trp Ile Glu Ala Trp
Val Glu Phe Ser Phe Pro Gly Arg Asn Asp Lys Tyr Ser Asp Phe His Trp Thr Trp Tyr His Phe Asp
Gly Val Asp Trp Asp Asp Ala Gly Lys Glu Lys Ala Ile Phe Lys Phe Lys Gly Asp Gly Lys Ala Trp
Asp Trp Glu Val Ser Ser Glu Lys Gly Asn Tyr Asp Tyr Leu Met Tyr Ala Asp Leu Asp Met Asp
His Pro Glu Val Lys Gln Glu Leu Lys Asp Trp Gly Glu Trp Tyr Leu Asn Met Thr Gly Val Asp Gly
Phe Arg Met Asp Ala Val Lys His Ile Lys Tyr Gln Tyr Leu Gln Glu Trp Ile Asp Tyr Leu Arg Lys
Lys Thr Gly Lys Glu Leu Phe Thr Val Gly Glu Tyr Trp Asn Tyr Asp Val Asn Asn Leu His Asn
Phe Met Thr Lys Thr Ser Gly Ser Met Ser Leu Phe Asp Ala Pro Leu His Met Asn Phe Tyr Asn Ala
Ser Arg Ser Gly Gly Asn Phe Asp Met Arg Arg Ile Met Asp Gly Thr Leu Met Lys Asp Asn Pro
Val Lys Ala Val Thr Leu Val Glu Asn His Asp Thr Gln Pro Leu Gln Ala Leu Glu Ser Pro Val Asp
Trp Trp Phe Lys Pro Leu Ala Tyr Ala Phe Ile Leu Leu Arg Glu Glu Gly Tyr Pro Ser Val Phe Tyr
Ala Asp Tyr Tyr Gly Ala Gln Tyr Ser Asp Lys Gly His Asp Ile Asn Met Val Lys Val Pro Tyr Ile
Glu Gln Leu Val Lys Ala Arg Lys Asp Tyr Ala Tyr Gly Lys Gln His Ser Tyr Leu Asp His Trp Asp
Val Ile Gly Trp Thr Arg Glu Gly Asp Ala Glu His Pro Asn Ser Met Ala Val Ile Met Ser Asp Gly
Pro Gly Gly Thr Lys Trp Met Tyr Thr Gly Ser Pro Ser Thr Arg Tyr Val Asp Lys Leu Gly Ile Arg
Thr Glu Glu Val Trp Thr Asn Ala Ser Gly Trp Ala Glu Phe Pro Val Asn Gly Gly Ser Val Ser Val
Trp Val Gly Val Lys SEQ ID NO: 141
atgaaaccaataaataccctactcatatccgcccttgctgtttgttctttcagttccgcgacttacgccgatactattttgcacgcgttcaattggaagt
attcagatgtgacggccaacgcgaatcaaattgctcaagctggttataagaaagtgcttgttgcgcctgcaatgaaatcgagtggcagccaatgg
tgggctcgctatcaacctcaagatctacgcactatcgattctcctttgggcaataaacaagattagccgcaatgattgccgcactcaaaggtgtg
ggcgtcgatgtgtatgccgatgtggtactcaaccatatggcgaatgaaagctggaagcgaagtgacttgaattaccctggcacagaagtgctaa
acgattatgctagccgttcaagctactatgctgaccagactctgtttggcaacctagcacaaggttatgtgtcagcgaacgactttcatccagcgg
gctgtatttcagattggaacgaccctggtcatgttcagtattggcgtttgtgtggcgcagatggtgatgtaggtttacctgaccttgatccaaacaac
tgggtggtttcacaacagcgtttgtatctgaaagcgctaaagatatgggcatcaaagggttccggattgttgcagtgaagcacatgagccaata
ccaaatcgatcaggtattcacgattgggaaattactgcgacgttgctatgtcttggtttggctaaagattactagcgcatagcgaactatacgcctatc
aatogttcttagcgccttaccttaaattactaaatcaatctgcttacgattcocgctgttcgcatcgattcgctcgcattictatgaggacgcggttt
aaatcaactgcatgatcctaaagcgtacggtcaggcacttgatgataatcgctcgatcaccttgcgatcacacatgatattccaaccaatgacgg
cttccgctaccaaattatggacccacaagacgagcagcttgcttacgcgtatatccttggtaaagacggtggcacgccgctgatctacagtgatg
atcttcctgattctgaagacaaggataacggtcgttgggggcaatgtttggaacagttcgacaatgaaaaacatgttgagcttccataacgcgatgc
aaggcaaaacaatgacgatgatttctagcgaccattgcactttgttgtttaagcgtggcaaagaaggtgttgtgggtattaacaagtgtggtgaaa
cgcgtggcgtgacggttgatacctaccaacatgagtttaattggcatgttcaatacaaagacgtgttaagcagcgcaacagaaaccgtgacttct
cgttaccatacgttcaatctaccaccacgcagtgcgcgtatgtttaagctgtag SEQ ID NO: 142
Met Lys Pro Ile Asn Thr Leu Leu Ile Ser Ala Leu Ala Val Cys Ser Phe Ser Ser Ala Thr Tyr Ala
Asp Thr Ile Leu His Ala Phe Asn Trp Lys Tyr Ser Asp Val Thr Ala Asn Ala Asn Gln Ile Ala Gln
Ala Gly Tyr Lys Lys Val Leu Val Ala Pro Ala Met Lys Ser Ser Gly Ser Gln Trp Trp Ala Arg Tyr
Gln Pro Gln Asp Leu Arg Thr Ile Asp Ser Pro Leu Gly Asn Lys Gln Asp Leu Ala Ala Met Ile Ala

FIGURE 16FFF

Ala Leu Lys Gly Val Gly Val Asp Val Tyr Ala Asp Val Val Leu Asn His Met Ala Asn Glu Ser Trp
Lys Arg Ser Asp Leu Asn Tyr Pro Gly Thr Glu Val Leu Asn Asp Tyr Ala Ser Arg Ser Ser Tyr Tyr
Ala Asp Gln Thr Leu Phe Gly Asn Leu Ala Gln Gly Tyr Val Ser Ala Asn Asp Phe His Pro Ala Gly
Cys Ile Ser Asp Trp Asn Asp Pro Gly His Val Gln Tyr Trp Arg Leu Cys Gly Ala Asp Gly Asp Val
Gly Leu Pro Asp Leu Asp Pro Asn Asn Trp Val Val Ser Gln Gln Arg Leu Tyr Leu Lys Ala Leu
Lys Asp Met Gly Ile Lys Gly Phe Arg Ile Asp Ala Val Lys His Met Ser Gln Tyr Gln Ile Asp Gln
Val Phe Thr Ser Glu Ile Thr Ala Asn Met His Val Phe Gly Glu Val Ile Thr Ser Gly Gly Ala Gly
Asn Ser Gly Tyr Glu Ser Phe Leu Ala Pro Tyr Leu Asn Asn Thr Asn His Ser Ala Tyr Asp Phe Pro
Leu Phe Ala Ser Ile Arg Ser Ala Phe Ser Met Gly Gly Gly Leu Asn Gln Leu His Asp Pro Lys Ala
Tyr Gly Gln Ala Leu Asp Asp Asn Arg Ser Ile Thr Phe Ala Ile Thr His Asp Ile Pro Thr Asn Asp
Gly Phe Arg Tyr Gln Ile Met Asp Pro Gln Asp Glu Gln Leu Ala Tyr Ala Tyr Ile Leu Gly Lys Asp
Gly Gly Thr Pro Leu Ile Tyr Ser Asp Asp Leu Pro Asp Ser Glu Asp Lys Asp Asn Gly Arg Trp Gly
Asn Val Trp Asn Ser Ser Thr Met Lys Asn Met Leu Ser Phe His Asn Ala Met Gln Gly Lys Thr
Met Thr Met Ile Ser Ser Asp His Cys Thr Leu Leu Phe Lys Arg Gly Lys Glu Gly Val Val Gly Ile
Asn Lys Cys Gly Glu Thr Arg Gly Val Thr Val Asp Thr Tyr Gln His Glu Phe Asn Trp His Val Gln
Tyr Lys Asp Val Leu Ser Ser Ala Thr Glu Thr Val Thr Ser Arg Tyr His Thr Phe Asn Leu Pro Pro
Arg Ser Ala Arg Met Phe Lys Leu

SEQ ID NO: 143
atgccaaagagcacttttaccaaatccataacaaaatcacttcttgctacttccgttgttgtaagcttattgcctgcctacgcacaggccgacactat
cttgcatgccttaactggaaatacagcgacattacccgccaagcagagcaaattgcgcaagctggttataaaaaagtactgatttcaccgccgc
tgaagtccacaggcccacaatggtgggcacgttaccaaccacaggacattcgagtgattgactccctgtcggcaacaagcaagatttacaag
ccctcattgcagccttaaaggcacaaggcgttgaagtatacgcagacatcgtactcaaccacatggccaacgaaagctggaaacgagacgatc
tgaactacccgggaagtgatttacttacccaatacagccaaaatatggcttacatgaaccagcaaaaattgtttggagatttagagcaaaatcagtt
ctctgccaatgattttcacccggctggctgcattactgattggagtaacccggggcatgttcaatactggcgcttatgtggtggtaatggtgacact
gggttacctgatcttgatcctaactcgtgggtgatcgatcaacaaaaacgttatttacgtgctttgaaagacatgggaataaagggcttccgagttg
atgcggtaaaacacatgagcgattaccaaatcaaccaagtgtttacgccagacatcatcgcaggcttacatgtatttggtgaagtgatcaccagtg
gtggcaagggcagcaatgactaccactctttctggaaccgtatttaaataacaccaatcacgccgcgtatgacttcccgctatttgcctctatccg
aaatgcatttagttatcatggcagcttgtctcaattacatgatccacaagcttacgggcaagcacttcctaacgacagagccattactttcaccatca
ctcacgacattccaaccaatgatggtttccgttaccaaatcatggatccaaccagtgaaaaactcgcgtacgcgtacattctaggcaaagatggg
ggtagcccacttatctatagcgatgctttagacccaagtgaagataaagataagggccgctggcgtgatgtatggaaccaagaatacatggttaa
catgatcagcttccacaacaaggtgcaaggtaaaagcatggaggtcatgtacagcgatcaatgcttgctggtctttaaacgtgaaaaacaaggct
tagtcggtattaataagtgcgctgaaagccgtacctacaccatagatacccatcgttttgaatttaactggtaccaaccgtacaacgacacattaag
ccagcacagcgagacctttagcagccgttatcatgctctgaccattccggcgcaaacagcacgaatgttggcgctataa SEQ ID NO: 144
Met Pro Lys Ser Thr Phe Thr Lys Ser Ile Thr Lys Ser Leu Leu Ala Thr Ser Val Val Val Ser Leu
Leu Pro Ala Tyr Ala Gln Ala Asp Thr Ile Leu His Ala Phe Asn Trp Lys Tyr Ser Asp Ile Thr Arg
Gln Ala Glu Gln Ile Ala Gln Ala Gly Tyr Lys Lys Val Leu Ile Ser Pro Pro Leu Lys Ser Thr Gly Pro
Gln Trp Trp Ala Arg Tyr Gln Pro Gln Asp Ile Arg Val Ile Asp Ser Pro Val Gly Asn Lys Gln Asp
Leu Gln Ala Leu Ile Ala Ala Leu Lys Ala Gln Gly Val Glu Val Tyr Ala Asp Ile Val Leu Asn His
Met Ala Asn Glu Ser Trp Lys Arg Asp Asp Leu Asn Tyr Pro Gly Ser Asp Leu Leu Thr Gln Tyr Ser
Gln Asn Met Ala Tyr Met Asn Gln Gln Lys Leu Phe Gly Asp Leu Glu Gln Asn Gln Phe Ser Ala
Asn Asp Phe His Pro Ala Gly Cys Ile Thr Asp Trp Ser Asn Pro Gly His Val Gln Tyr Trp Arg Leu
Cys Gly Gly Asn Gly Asp Thr Gly Leu Pro Asp Leu Asp Pro Asn Ser Trp Val Ile Asp Gln Gln Lys
Arg Tyr Leu Arg Ala Leu Lys Asp Met Gly Ile Lys Gly Phe Arg Val Asp Ala Val Lys His Met Ser
Asp Tyr Gln Ile Asn Gln Val Phe Thr Pro Asp Ile Ile Ala Gly Leu His Val Phe Gly Glu Val Ile Thr
Ser Gly Gly Lys Gly Ser Asn Asp Tyr His Ser Phe Leu Glu Pro Tyr Leu Asn Asn Thr Asn His Ala
Ala Tyr Asp Phe Pro Leu Phe Ala Ser Ile Arg Asn Ala Phe Ser Tyr His Gly Ser Leu Ser Gln Leu
His Asp Pro Gln Ala Tyr Gly Gln Ala Leu Pro Asn Asp Arg Ala Ile Thr Phe Thr Ile Thr His Asp

FIGURE 16GGG

Ile Pro Thr Asn Asp Gly Phe Arg Tyr Gln Ile Met Asp Pro Thr Ser Glu Lys Leu Ala Tyr Ala Tyr
Ile Leu Gly Lys Asp Gly Gly Ser Pro Leu Ile Tyr Ser Asp Ala Leu Asp Pro Ser Glu Asp Lys Asp
Lys Gly Arg Trp Arg Asp Val Trp Asn Gln Glu Tyr Met Val Asn Met Ile Ser Phe His Asn Lys Val
Gln Gly Lys Ser Met Glu Val Met Tyr Ser Asp Gln Cys Leu Leu Val Phe Lys Arg Glu Lys Gln
Gly Leu Val Gly Ile Asn Lys Cys Ala Glu Ser Arg Thr Tyr Thr Ile Asp Thr His Arg Phe Glu Phe
Asn Trp Tyr Gln Pro Tyr Asn Asp Thr Leu Ser Gln His Ser Glu Thr Phe Ser Ser Arg Tyr His Ala
Leu Thr Ile Pro Ala Gln Thr Ala Arg Met Leu Ala Leu

SEQ ID NO: 145
atgttgaaaaggattacggtagtctgtttattatttatttgcttttttcctaatatatatgggaggaataaggcggaagcagcaacgataaataatgga
acattaatgcagtattttgagtggtacgctccgaatgatgggaatcattggaatcgtttgcgttatgatgctgaaagtttagctcataagggaatcac
atctgtatggataccacctgcatataaagggacttcgcaaaatgatgtagggtatggggcctatgattatacgatttaggggagttcaatcaaaaa
ggaacggtgcggacgaaatatgggacaaaggcacagttgaaatctgcaattgacgctttacataagcaaaacatcgacgtatacggtgatgta
gttatgaatcataaaggtgggctgattatactgaaaccgtaacagctgttgaggtagaccgtaacaatcgaaatattgaagtatcaggtgattatg
aaattagtgcgtggacgggttttaactttccagggcgcagagatgcttattctaatttcaaatggaaatggtatcattttgacggaacggattgggat
gaaggaaggaaattaaaccgaatttataaatttagggggtataggtaaagcgtgggactgggaagtgtctagcgaaaatggaaattatgattatttg
atgtatgcagatcttgatttttgatcatccagatgttgcgaatgaaatgaaaagttggggaacgtggtatgcgaatgaattaaatttagatggatttcgt
ttagatgctgttaaacatattgatcatgaatatttacgcgattgggtaaatcatgtcagacagcaaacggggaaagaaatgtttacggtggctgaat
attggcaaaatgatatccagactttaaacaattatttggcgaaagtcaattataatcaatctgtatttgatgcaccgcttcattacaattttcattatgctt
caacaggaaatgggaattatgatatgagaaatattttaaatggaacagtaatgaaaaatcatcctgcactcgcagttactctcgttgagaatcatga
ttctcaacctgggcaatcattggaatctgtagtaagtccgtggtttaagccgctggcatatgcatttattttaactcgtgcagagggctatccttcagt
tttttatggtgattactatgggacaagcggaaatagtagttatgaaattccagcgttaaaagataaaattgatccaattttgacggcacgaaaaaact
ttgcatatggtacgcagcgtgattatttagaccatccagatgtgattggctggacaagagaaggagatagtgtacatgctaagtctggtttagcgg
cattaatctccgatggaccaggaggatcaaagtggatggatgttggaaagaataacgctggggaagtatggtacgatattacgggtaatcaaac
aaatactgtaacaattaataaagatggatcggggcaattccatgtaagtggaggctctgtttctatatatgttcaacagtaa SEQ ID NO: 146
Met Leu Lys Arg Ile Thr Val Val Cys Leu Leu Phe Ile Leu Leu Phe Pro Asn Ile Tyr Gly Arg Asn
Lys Ala Glu Ala Ala Thr Ile Asn Asn Gly Thr Leu Met Gln Tyr Phe Glu Trp Tyr Ala Pro Asn Asp
Gly Asn His Trp Asn Arg Leu Arg Tyr Asp Ala Glu Ser Leu Ala His Lys Gly Ile Thr Ser Val Trp
Ile Pro Pro Ala Tyr Lys Gly Thr Ser Gln Asn Asp Val Gly Tyr Gly Ala Tyr Asp Leu Tyr Asp Leu
Gly Glu Phe Asn Gln Lys Gly Thr Val Arg Thr Lys Tyr Gly Thr Lys Ala Gln Leu Lys Ser Ala Ile
Asp Ala Leu His Lys Gln Asn Ile Asp Val Tyr Gly Asp Val Val Met Asn His Lys Gly Gly Ala Asp
Tyr Thr Glu Thr Val Thr Ala Val Glu Val Asp Arg Asn Asn Arg Asn Ile Glu Val Ser Gly Asp Tyr
Glu Ile Ser Ala Trp Thr Gly Phe Asn Phe Pro Gly Arg Arg Asp Ala Tyr Ser Asn Phe Lys Trp Lys
Trp Tyr His Phe Asp Gly Thr Asp Trp Asp Glu Gly Arg Lys Leu Asn Arg Ile Tyr Lys Phe Arg Gly
Ile Gly Lys Ala Trp Asp Trp Glu Val Ser Ser Glu Asn Gly Asn Tyr Asp Tyr Leu Met Tyr Ala Asp
Leu Asp Phe Asp His Pro Asp Val Ala Asn Glu Met Lys Ser Trp Gly Thr Trp Tyr Ala Asn Glu Leu
Asn Leu Asp Gly Phe Arg Leu Asp Ala Val Lys His Ile Asp His Glu Tyr Leu Arg Asp Trp Val Asn
His Val Arg Gln Gln Thr Gly Lys Glu Met Phe Thr Val Ala Glu Tyr Trp Gln Asn Asp Ile Gln Thr
Leu Asn Asn Tyr Leu Ala Lys Val Asn Tyr Asn Gln Ser Val Phe Asp Ala Pro Leu His Tyr Asn
Phe His Tyr Ala Ser Thr Gly Asn Gly Asn Tyr Asp Met Arg Asn Ile Leu Asn Gly Thr Val Met Lys
Asn His Pro Ala Leu Ala Val Thr Leu Val Glu Asn His Asp Ser Gln Pro Gly Gln Ser Leu Glu Ser
Val Val Ser Pro Trp Phe Lys Pro Leu Ala Tyr Ala Phe Ile Leu Thr Arg Ala Glu Gly Tyr Pro Ser
Val Phe Tyr Gly Asp Tyr Tyr Gly Thr Ser Gly Asn Ser Ser Tyr Glu Ile Pro Ala Leu Lys Asp Lys
Ile Asp Pro Ile Leu Thr Ala Arg Lys Asn Phe Ala Tyr Gly Thr Gln Arg Asp Tyr Leu Asp His Pro
Asp Val Ile Gly Trp Thr Arg Glu Gly Asp Ser Val His Ala Lys Ser Gly Leu Ala Ala Leu Ile Ser
Asp Gly Pro Gly Gly Ser Lys Trp Met Asp Val Gly Lys Asn Asn Ala Gly Glu Val Trp Tyr Asp Ile
Thr Gly Asn Gln Thr Asn Thr Val Thr Ile Asn Lys Asp Gly Ser Gly Gln Phe His Val Ser Gly Gly
Ser Val Ser Ile Tyr Val Gln Gln

FIGURE 16HHH

SEQ ID NO: 147
atgagcttaaataacttttaaggtaaaactgcttagtttgctgtgtcttctgctgtattgtcactggctccaaatttagccaatgctgcaaattttgaaag
tgagatggtgataatccatccgtttcagtggacatatgacaatatagcaaaagagtgtacagagtaccttggtccagccggatttgacggtgtaca
gatttcccagccagcggaacataagcgggctgaaggagtatggtgggccgtatatcagccggttaattataagaattttacaaccatgaccggta
acgaggagcagcttaaggcaatgatcaagacctgtaatgatgcaggtgttaaggtgttcgctgacgctgttttcaaccaaaaggctacagacgg
tgtaggctggggcggttcaacttggagttataagaactaccctgacggattctccggatcagatttccatggagactgttccattgacaaaagctat
actgatgcaaataatgtcagaacctgtgcactctcaggtatgccggacgttgccacagataactccgctactcaggaaaagattgcagattacct
cgcttctttaatgaatatgggggtctatggtttccgtattgacgctgcaaagcacatgggatacaacgatatcaactccattctttcaaaaactgcac
agaagactggaagaagacctcctgcatatctggaagtaatcggagccggtaacgaagctgccgacattcagccggacaagtatacctttattga
gaatgcggttgtaactgacttcggttatgtctgggatgcaaatgagagtttcggaaagggtaattacggtaaggcactggaactcagtacctggct
cggtgcaaattcagaaacattcgtaaacaatcatgatgatgaatggggcagatgctcagccggtagctgctcaatgaaaactcagaattatgctg
attataatctggctcagtcctggcttgctgtatggcctgtaggtacagtaagacagatatattccggttattcattccctgtaaaagataatgatcctta
tcgcgtcagtgatgcaactcatgatcagggcgggcctcttggtgccgaccgctgtgaaggtggctggttgtgtcagcaccgtgtgtcttcgttct
caattccccaagatttgcgagagctaccagaggtactgctgtatcaaccaagggatttgacaatggtgctttgtggtttaacagaggaagcaaag
gttttatgcacagaatactaccaacagtcctataaccagacattctctgttgaagtacctgacggaaattactgtgatatcttaggaacatcagat
cctaagagcaatccatgcggagcagacgttgtcgtaagcggcggtaaggctacctttactattcctgcaaagacagctgtggctatctgtacaga
ctcagactggtgcggcaagggggttgatccttgtgaaagtgatccgaccggtgctgcctgtgtttgtaaggggggaaaccaccgttaatggtgtgt
gcgtcagctggtgtaatgcgcattcatcaaatgaggaatgcacctgtgtattgaatccgaatgatgccaactgtcaggctgatattgaacctacca
agggtaaactctgttacgccggtacttcaaacgggtggaaacaggatcctttaacatataaccgtaaaacaggtttctggactattaatctgactctt
gacggtgcaggtgataccagcggagctcagcgcttcaaggttacagacggatgttcatggaccggaacagtttacggttcttcaggtactgccg
gaaagttggatgtaaatacatcatcaaccggcgatgaacctgtgtctcttgttggtgattatgttctttccattaacgataagaccatggaatatacat
tcaccaaggcagatgaagtaactaatcagccaccggttgcatcatttaccgcgacagttaacggtctgaccgtttctttgccaataattcatccga
ccctgagaatgatgaattaacctacagctggaatttcggtaatggtaaaacatcatccgagaaagctcctagcataacctatgaagaatccggta
agtatactgttactttaaaggttactgattcagctaataacactgatacatttactaaagatataactgtaacagcaccttctagtggcaagtacttaaa
ggttgcagtcagaggttcgcatgataattacggaactgatctgttaaccaagaacggttctgattggaccggcgtctttgaattctttggatccacta
gtgtcgacctgcaggcgcgcgagctc SEQ ID NO: 148
Met Ser Leu Asn Asn Phe Lys Val Lys Leu Leu Ser Phe Ala Val Ser Ser Ala Val Leu Ser Leu Ala
Pro Asn Leu Ala Asn Ala Ala Asn Phe Glu Ser Glu Met Val Ile Ile His Pro Phe Gln Trp Thr Tyr
Asp Asn Ile Ala Lys Glu Cys Thr Glu Tyr Leu Gly Pro Ala Gly Phe Gly Val Gln Ile Ser Gln
Pro Ala Glu His Lys Arg Ala Glu Gly Val Trp Trp Ala Val Tyr Gln Pro Val Asn Tyr Lys Asn Phe
Thr Thr Met Thr Gly Asn Glu Glu Gln Leu Lys Ala Met Ile Lys Thr Cys Asn Asp Ala Gly Val Lys
Val Phe Ala Asp Ala Val Phe Asn Gln Lys Ala Thr Asp Gly Val Gly Trp Gly Gly Ser Thr Trp Ser
Tyr Lys Asn Tyr Pro Asp Gly Phe Ser Gly Ser Asp Phe His Gly Asp Cys Ser Ile Asp Lys Ser Tyr
Thr Asp Ala Asn Asn Val Arg Thr Cys Ala Leu Ser Gly Met Pro Asp Val Ala Thr Asp Asn Ser Ala
Thr Gln Glu Lys Ile Ala Asp Tyr Leu Ala Ser Leu Met Asn Met Gly Val Tyr Gly Phe Arg Ile Asp
Ala Ala Lys His Met Gly Tyr Asn Asp Ile Asn Ser Ile Leu Ser Lys Thr Ala Gln Lys Thr Gly Arg
Arg Pro Pro Ala Tyr Leu Glu Val Ile Gly Ala Gly Asn Glu Ala Ala Asp Ile Gln Pro Asp Lys Tyr
Thr Phe Ile Glu Asn Ala Val Val Thr Asp Phe Gly Tyr Val Trp Asp Ala Asn Glu Ser Phe Gly Lys
Gly Asn Tyr Gly Lys Ala Leu Glu Leu Ser Thr Trp Leu Gly Ala Asn Ser Glu Thr Phe Val Asn Asn
His Asp Asp Glu Trp Gly Arg Cys Ser Ala Gly Ser Cys Ser Met Lys Thr Gln Asn Tyr Ala Asp Tyr
Asn Leu Ala Gln Ser Trp Leu Ala Val Trp Pro Val Gly Thr Val Arg Gln Ile Tyr Ser Gly Tyr Ser
Phe Pro Val Lys Asp Asn Asp Pro Tyr Arg Val Ser Asp Ala Thr His Asp Gln Gly Gly Pro Leu Gly
Ala Asp Arg Cys Glu Gly Gly Trp Leu Cys Gln His Arg Val Ser Phe Val Leu Asn Ser Pro Arg Phe
Ala Arg Ala Thr Arg Gly Thr Ala Val Ser Thr Lys Gly Phe Asp Asn Gly Ala Leu Trp Phe Asn Arg
Gly Ser Lys Gly Phe Tyr Ala Gln Asn Thr Thr Asn Ser Pro Ile Thr Gln Thr Phe Ser Val Glu Val
Pro Asp Gly Asn Tyr Cys Asp Ile Leu Gly Thr Ser Asp Pro Lys Ser Asn Pro Cys Gly Ala Asp Val
Val Val Ser Gly Gly Lys Ala Thr Phe Thr Ile Pro Ala Lys Thr Ala Val Ala Ile Cys Thr Asp Ser

FIGURE 16III

Asp Trp Cys Gly Lys Gly Val Asp Pro Cys Glu Ser Asp Pro Thr Gly Ala Ala Cys Val Cys Lys Gly
Glu Thr Thr Val Asn Gly Val Cys Val Ser Trp Cys Asn Ala His Ser Ser Asn Glu Glu Cys Thr Cys
Val Leu Asn Pro Asn Asp Ala Asn Cys Gln Ala Asp Ile Glu Pro Thr Lys Gly Lys Leu Cys Tyr Ala
Gly Thr Ser Asn Gly Trp Lys Gln Asp Pro Leu Thr Tyr Asn Arg Lys Thr Gly Phe Trp Thr Ile Asn
Leu Thr Leu Asp Gly Ala Gly Asp Thr Ser Gly Ala Gln Arg Phe Lys Val Thr Asp Gly Cys Ser Trp
Thr Gly Thr Val Tyr Gly Ser Ser Gly Thr Ala Gly Lys Leu Asp Val Asn Thr Ser Ser Thr Gly Asp
Glu Pro Val Ser Leu Val Gly Asp Tyr Val Leu Ser Ile Asn Asp Lys Thr Met Glu Tyr Thr Phe Thr
Lys Ala Asp Glu Val Thr Asn Gln Pro Pro Val Ala Ser Phe Thr Ala Thr Val Asn Gly Leu Thr Val
Ser Phe Ala Asn Asn Ser Ser Asp Pro Glu Asn Asp Glu Leu Thr Tyr Ser Trp Asn Phe Gly Asn Gly
Lys Thr Ser Ser Glu Lys Ala Pro Ser Ile Thr Tyr Glu Glu Ser Gly Lys Tyr Thr Val Thr Leu Lys
Val Thr Asp Ser Ala Asn Asn Thr Asp Thr Phe Thr Lys Asp Ile Thr Val Thr Ala Pro Ser Ser Gly
Lys Tyr Leu Lys Val Ala Val Arg Gly Ser His Asp Asn Tyr Gly Thr Asp Leu Leu Thr Lys Asn Gly
Ser Asp Trp Thr Gly Val Phe Glu Phe Phe Gly Ser Thr Ser Val Asp Leu Gln Ala Arg Glu Leu

SEQ ID NO: 149
atgatcttaagtaattttaaggtaaaacttcttagttttgctgtgtcttctgctgtactgacactggctgcaaatgtcgccaatgccaagaattatgaaa
gtgaaatggttattattcatccattcagtggacatatgacaatatagcaaaagaatgtactgagtatctgggacctgcgggatttgacggggtgca
gatttcccaggcggctgagcataaagatgccggtggtgcatggtggggtacctaccagcctgtaaacttcaagagttttactaccatggttggta
atgaagaacagcttagagcaatgattaaaacctgtaacgaggcaggtgttaaggtctttgccgatgccgtgattaatcagaaagccggcgacgg
tgtaggtataggtggttcaacttcggaaattataattatcctgacggatttaccagtgatgatttcatcataataactgcagtataggtaataattatt
cagatgcatgggtagtaagattctgtgacctcagtggcatgccggatatagcaactgataacgacagtaccagaaataagattgctgattacttcg
ccagcctatgaatatgggggtatacggattccgtattgatgctgccaagcactttagctatgatgatatagacgctattgtagagaaaacagcaa
ccaaagcaggcaggagacctcctgtctatatggaggttatcggtaatccgggtcaagaggcggatgatatccagccgaacaagtatacatgga
ttgataatgccgttgtaacagatttacttatgctaatagcatgcataatatttttaacggaagcggttatgccaaggctttgaacatggggctagggc
atgttgatgctgaaaatgccgaagtcttataagtaatcatgataatgaatggggaagaaagtctgccggttcctgctcaataagaacccagaata
atccggattaccatctggctcagtcctggctcgcagtttggcctttaggcaaggttagacagatttattctgcatatcagttcccggtctttgaagata
gttgtgagcgggtcagtcagcaagcccatgatcagggcggtcctatcggggcagcccgctgtgaaggtggctggttgtgtcagcaccgtgtac
cgtttgtgctcaattctcctagattttgcaagagcaaccagagggacagtcgttactactaaaggttttgatgacggagctttgtggtttaacagagg
aagcaagggcttctatgcccagaatactaccggcagttctataactcatcattctcagttgaattacctgatggaaattactgtgatatccttggag
caaccgatccgaagaataatccttgcggagcggatgtcactgtaagcggaggtaaagcaaccttttaccattccggcaaagaccgccgtagcta
tctgtactgatgaaaagtggtgtggcaagggggttgaccccttgtgaaagcgatcctaccggttccgcctgtgtatgtaagggtgaaaccacagtt
aacggcgtatgtgtaagctggtgtaatgctcactcatctaatgaagaatgtgcctgtgtgcaaatcctaatgacgctgagtgtcaggccgacatt
gagccgaccaagggtaaactctgctatgtaggtacctccaacaagtggactcaggaaccttaacctataatcgcaagaccggtttctggactct
caacgttgaacttgacggtaagggggataccagcgggcgcagcgcttaaagttaccgacggctgttcatggcagggtactgtttacggttca
tcaggagtagaaggcagacttgacgtaaatacttcagccaccggagatgaaccggtttcactgacaggtaaatatgttctttccatataatgataag
accatggaatacacattcattcctgcaggcagtgaaacaagcctccggttgcgtcatttactccgactgttaaagatctgactgtatctttgtcaa
taattcatccgaagctgagaatgatgtattaactgacagctggaattcggtaacggtaaaacctatctgaaaagaatcagagttgttacatatgat
aaagccggtaaatatactgtttcactcaaagtaaacgatactgcaaacacacatgataccaaaacactggaaatggattaacatctcctgttaacg
gaaaatattccaaggttgcagtcagaggttcacatgataactacggaacaaatctgttaaccaggaatggttcagaatggaccggtatctttgaatt
cagtaagacaaccaaattcaagcttgaagctctgcctcctgcagctgaccagtgtatcttcctcggcggtaatcgaggtgaggcattgactgcct
ccggtggatttatatctcttcctgccggaaggtatactataaagtttaatgaggaaagcaaggttcttactgcaggcgatgttgactgcaccggg SEQ ID NO: 150
Met Ile Leu Ser Asn Phe Lys Val Lys Leu Leu Ser Phe Ala Val Ser Ser Ala Val Leu Thr Leu Ala
Ala Asn Val Ala Asn Ala Lys Asn Tyr Glu Ser Glu Met Val Ile Ile His Pro Gln Trp Thr Tyr
Asp Asn Ile Ala Lys Glu Cys Thr Glu Tyr Leu Gly Pro Ala Gly Phe Asp Gly Val Gln Ile Ser Gln
Ala Ala Glu His Lys Asp Ala Gly Gly Ala Trp Trp Gly Thr Tyr Gln Pro Val Asn Phe Lys Ser Phe
Thr Thr Met Val Gly Asn Glu Glu Gln Leu Arg Ala Met Ile Lys Thr Cys Asn Glu Ala Gly Val Lys
Val Phe Ala Asp Ala Val Ile Asn Gln Lys Ala Gly Asp Gly Val Gly Ile Gly Gly Ser Thr Phe Gly
Asn Tyr Asn Tyr Pro Asp Gly Phe Thr Ser Asp Asp Phe His His Asn Asn Cys Ser Ile Gly Asn Asn

FIGURE 16JJJ

Tyr Ser Asp Ala Trp Val Val Arg Phe Cys Asp Leu Ser Gly Met Pro Asp Ile Ala Thr Asp Asn Asp
Ser Thr Arg Asn Lys Ile Ala Asp Tyr Phe Ala Ser Leu Met Asn Met Gly Val Tyr Gly Phe Arg Ile
Asp Ala Ala Lys His Phe Ser Tyr Asp Asp Ile Asp Ala Ile Val Glu Lys Thr Ala Thr Lys Ala Gly
Arg Arg Pro Pro Val Tyr Met Glu Val Ile Gly Asn Pro Gly Gln Glu Ala Asp Asp Ile Gln Pro Asn
Lys Tyr Thr Trp Ile Asp Asn Ala Val Val Thr Asp Phe Thr Tyr Ala Asn Ser Met His Asn Ile Phe
Asn Gly Ser Gly Tyr Ala Lys Ala Leu Asn Met Gly Leu Gly His Val Asp Ala Glu Asn Ala Glu Val
Phe Ile Ser Asn His Asp Asn Glu Trp Gly Arg Lys Ser Ala Gly Ser Cys Ser Ile Arg Thr Gln Asn
Asn Pro Asp Tyr His Leu Ala Gln Ser Trp Leu Ala Val Trp Pro Leu Gly Lys Val Arg Gln Ile Tyr
Ser Ala Tyr Gln Phe Pro Val Phe Glu Asp Ser Cys Glu Arg Val Ser Gln Gln Ala His Asp Gln Gly
Gly Pro Ile Gly Ala Ala Arg Cys Glu Gly Gly Trp Leu Cys Gln His Arg Val Pro Phe Val Leu Asn
Ser Pro Arg Phe Ala Arg Ala Thr Arg Gly Thr Val Val Thr Thr Lys Gly Phe Asp Asp Gly Ala Leu
Trp Phe Asn Arg Gly Ser Lys Gly Phe Tyr Ala Gln Asn Thr Thr Gly Ser Ser Ile Thr His Thr Phe
Ser Val Glu Leu Pro Asp Gly Asn Tyr Cys Asp Ile Leu Gly Ala Thr Asp Pro Lys Asn Asn Pro Cys
Gly Ala Asp Val Thr Val Ser Gly Gly Lys Ala Thr Phe Thr Ile Pro Ala Lys Thr Ala Val Ala Ile
Cys Thr Asp Glu Lys Trp Cys Gly Lys Gly Val Asp Pro Cys Glu Ser Asp Pro Thr Gly Ser Ala Cys
Val Cys Lys Gly Glu Thr Thr Val Asn Gly Val Cys Val Ser Trp Cys Asn Ala His Ser Ser Asn Glu
Glu Cys Ala Cys Val Leu Asn Pro Asn Asp Ala Glu Cys Gln Ala Asp Ile Glu Pro Thr Lys Gly Lys
Leu Cys Tyr Val Gly Thr Ser Asn Lys Trp Thr Gln Glu Pro Leu Thr Tyr Asn Arg Lys Thr Gly Phe
Trp Thr Leu Asn Val Glu Leu Asp Gly Lys Gly Asp Thr Ser Gly Ala Gln Arg Phe Lys Val Thr
Asp Gly Cys Ser Trp Gln Gly Thr Val Tyr Gly Ser Ser Gly Val Glu Gly Arg Leu Asp Val Asn Thr
Ser Ala Thr Gly Asp Glu Pro Val Ser Leu Thr Gly Lys Tyr Val Leu Ser Ile Asn Asp Lys Thr Met
Glu Tyr Thr Phe Ile Pro Ala Gly Ser Gly Asn Lys Pro Pro Val Ala Ser Phe Thr Pro Thr Val Lys
Asp Leu Thr Val Ser Phe Val Asn Asn Ser Ser Asp Pro Glu Asn Asp Glu Leu Thr Tyr Ser Trp Asn
Phe Gly Asn Gly Lys Thr Ser Ser Glu Lys Asn Pro Ser Val Thr Tyr Asp Lys Ala Gly Lys Tyr Thr
Val Ser Leu Lys Val Thr Asp Thr Ala Asn Asn Thr Asp Thr Lys Thr Leu Glu Ile Asp Leu Thr Ser
Pro Val Asn Gly Lys Tyr Ser Lys Val Ala Val Arg Gly Ser His Asp Asn Tyr Gly Thr Asn Leu Leu
Thr Arg Asn Gly Ser Glu Trp Thr Gly Ile Phe Glu Phe Ser Lys Thr Thr Lys Phe Lys Leu Glu Ala
Leu Pro Pro Ala Ala Asp Gln Cys Ile Phe Leu Gly Gly Asn Arg Gly Glu Ala Leu Thr Ala Ser Gly
Gly Phe Ile Ser Leu Pro Ala Gly Arg Tyr Thr Ile Lys Phe Asn Glu Glu Ser Lys Val Leu Thr Ala
Gly Asp Val Asp Cys Thr Gly

SEQ ID NO: 151
atgaaaactattctttcaacaatcatggtgatggcggctgcggctgccaccaccgtagaggctcaaggctggccggaaaactacggcggcgtc
atgttgcagggattctactgggattcctattcagccaccaagtggactaaactggaagcacaggctgacgagatctgcaactattctcgctggta
tgggtaccacagtcggctataccggcagcagtacctccatgggctacgacccgctgtattacttcgaccagcattcatcgttcggcaccgaag
a[illegible lines]
ctt[illegible]
gaacgtgcagaaatcggttcttgcctacaccaaatatctggttgacgacttaggctataccggattccgotacgatatggtaaaggattgacgg
atcgcatgtagccgactacaacaccaatgccggcgtgcagttctctgtcggcgaatattgggacggcactgcatcgaaagtttacagttggatca
acagcaccaaaaagagcgatgtgccgcagtcggcagccttcgacttcgctttccgatacacctgccgcgatgccgtcaacaacaagaactgg
gcgaacctgaagaacacttccggtatcagcgatgccgattacaggcgctattcggttacgtttgttgaaaatcacgatacggaataccgttcagct
acggcttcccaggatcccatcaagggtgatacggttgccctcaatgcctggatgctggctatgccgggcacaccttgtgttttcctgaaacattgg
accgactgcaaggaagagatcaagaatctcatcgaggcacgtcgcctggtcggtattcacaaccagagcacctatgccgaatggatgagcgg
tgcagcctacatcggacgtaccgtaacaggtacgaacggcaccttacgtgttctgtgcggctcttatcagtataatgtagccgccaactacattca
gattctctcaggcaaaaactataaatactacgtactcaacacgctcgaggctccctggatcgggaaaggttccggctcgtacaccgaaggtgaa
accgtaacggttccgctcatcgccatatcggccgatgccaatgccaagctggtatataccaccgacggcacagaccccaccgcaacctcaaca
gccgtaaccagcggaacggaactgaccatcacttcggacgccgtcctgaaggttggtctgctttccggcggcatcgtcaggaacatacagagc
cgtacattcaccttccaggctgcaaacacctccgagtattacacagccaccatgcacgtatgcaaccagtccggagctctcaatccgctgtttgc
ctatgtttgggcaggaccggacaacgagcagattaacggcaactggccgggcaccaagctcaccgctaccattaccgaaaacaaccttacct

FIGURE 16KKK ggtacacgcagtcgttccagattccgaagaacgtggactatgtcgtgaactttgttttcaccacaaccggcggcggtacgcagacagtggatgtt
accggcatgaaggccgatgtctggtacattattaacagtaccaagagcggcaacaagtacacggtaaccgacgttacctcacagtattcttcgtt
agaggccatctttgatgaagaaaactccggctccttccctgtctatgacctgcagggacgccgcgtcagcgaaattagaaacaggacaattatat
cttcagaacggaaagaagatactcatcagataaacagaggttccgaaccattctcctattatgaaaatcagacacttagtaatctcagcactgctg
ggtttgggggcttgtacaccatcagctgctcctcgtcggg SEQ ID NO: 152
Met Lys Thr Ile Leu Ser Thr Ile Met Val Met Ala Ala Ala Ala Ala Thr Thr Val Glu Ala Gln Gly
Trp Pro Glu Asn Tyr Gly Gly Val Met Leu Gln Gly Phe Tyr Trp Asp Ser Tyr Ser Ala Thr Lys Trp
Thr Lys Leu Glu Ala Gln Ala Asp Glu Ile Cys Asn Tyr Phe Ser Leu Val Trp Val Pro Gln Ser Ala
Tyr Thr Gly Ser Ser Thr Ser Met Gly Tyr Asp Pro Leu Tyr Tyr Phe Asp Gln His Ser Ser Phe Gly
Thr Glu Glu Gln Leu Arg Ser Phe Ile Ser Thr Tyr Lys Gln Lys Gly Thr Gly Ile Ile Ala Asp Val Val
Val Asn His Arg Lys Asn Val Ser Asn Trp Val Asp Phe Pro Ala Glu Thr Tyr Asn Gly Val Thr Tyr
Gln Met Val Ser Thr Asp Ile Val Ser Asn Asp Asp Gly Gly Lys Thr Ala Thr Trp Ala Asn Gln Asn
Gly Tyr Ser Leu Ser Ser Asn Ala Asp Glu Gly Glu Gly Trp Asp Gly Met Arg Asp Leu Asp His
Lys Ser Gln Asn Val Gln Lys Ser Val Leu Ala Tyr Thr Lys Tyr Leu Val Asp Asp Leu Gly Tyr Thr
Gly Phe Arg Tyr Asp Met Val Lys Gly Phe Asp Gly Ser His Val Ala Asp Tyr Asn Thr Asn Ala
Gly Val Gln Phe Ser Val Gly Glu Tyr Trp Asp Gly Thr Ala Ser Lys Val Tyr Ser Trp Ile Asn Ser
Thr Lys Lys Ser Asp Val Pro Gln Ser Ala Ala Phe Asp Phe Ala Phe Arg Tyr Thr Cys Arg Asp Ala
Val Asn Asn Lys Asn Trp Ala Asn Leu Lys Asn Thr Ser Gly Ile Ser Asp Ala Asp Tyr Arg Arg Tyr
Ser Val Thr Phe Val Glu Asn His Asp Thr Glu Tyr Arg Ser Ala Thr Ala Ser Gln Asp Pro Ile Lys
Gly Asp Thr Val Ala Leu Asn Ala Trp Met Leu Ala Met Pro Gly Thr Pro Cys Val Phe Leu Lys His
Trp Thr Asp Cys Lys Glu Glu Ile Lys Asn Leu Ile Glu Ala Arg Arg Leu Val Gly Ile His Asn Gln
Ser Thr Tyr Ala Glu Trp Met Ser Gly Ala Ala Tyr Ile Gly Arg Thr Val Thr Gly Thr Asn Gly Thr
Leu Arg Val Leu Cys Gly Ser Tyr Gln Tyr Asn Val Ala Ala Asn Tyr Ile Gln Ile Leu Ser Gly Lys
Asn Tyr Lys Tyr Tyr Val Leu Asn Thr Leu Glu Ala Pro Trp Ile Gly Lys Gly Ser Gly Ser Tyr Thr
Glu Gly Glu Thr Val Thr Val Pro Leu Ile Ala Ile Ser Ala Asp Ala Asn Ala Lys Leu Val Tyr Thr
Thr Asp Gly Thr Asp Pro Thr Ala Thr Ser Thr Ala Val Thr Ser Gly Thr Glu Leu Thr Ile Thr Ser
Asp Ala Val Leu Lys Val Gly Leu Leu Ser Gly Gly Ile Val Arg Asn Ile Gln Ser Arg Thr Phe Thr
Phe Gln Ala Ala Asn Thr Ser Glu Tyr Tyr Thr Ala Thr Met His Val Cys Asn Gln Ser Gly Ala Leu
Asn Pro Leu Phe Ala Tyr Val Trp Ala Gly Pro Asp Asn Glu Gln Ile Asn Gly Asn Trp Pro Gly Thr
Lys Leu Thr Ala Thr Ile Thr Glu Asn Asn Leu Thr Trp Tyr Thr Gln Ser Phe Gln Ile Pro Lys Asn
Val Asp Tyr Val Val Asn Phe Val Phe Thr Thr Thr Gly Gly Gly Thr Gln Thr Val Asp Val Thr Gly
Met Lys Ala Asp Val Trp Tyr Ile Ile Asn Ser Thr Lys Ser Gly Asn Lys Tyr Thr Val Thr Asp Val
Thr Ser Gln Tyr Ser Ser Leu Glu Ala Ile Phe Asp Glu Glu Asn Ser Gly Ser Phe Pro Val Tyr Asp
Leu Gln Gly Arg Arg Val Ser Glu Ile Arg Asn Arg Thr Ile Ile Ser Ser Glu Arg Lys Glu Asp Thr
His Gln Ile Asn Arg Gly Ser Glu Pro Phe Ser Tyr Tyr Glu Asn Gln Thr Leu Ser Asn Leu Ser Thr
Ala Gly Phe Gly Gly Leu Val His His Gln Leu Leu Leu Val Gly SEQ ID NO: 69
atgttgaaaaggattacggtagtctgtttattgtttattttgcttttttcctaatatatatgagggaaataaggcagaagcagcaacagtgaacaatgga
acattaatgcagtattttgagtggtacgctccgaatgatgggaatcattggaatcgtttgcgttccgatgctgaaagtttagctcataaaggaatcac
atctgtatggataccacctgcatataaagggacttcgcaaaatgatgtagggtatggggcctatgatttatatgatttaggggagttcaatcaaaaa
ggaacggtgcggacgaaatatgggacaaaagcacagttgaaatctgcaattgacgctttacataagcaaaacatcgacgtatacggtgatgtag
ttatgaatcataaaggtggggctgattatactgaaaccgtaacagctgttgaggtagaccgtaacaatcgaaatattgaagtatcaggtgattatca
aattagtgcatggacggggtttaattttccagggcgcggagatgcttattctaatttcaaatggaaatggtatcattttgacggaacggattgggatg
aaggaaggaaattaaatcgaatttataaatttaggggtgtagataaagcgtgggattgggaagtgtctagcgaaaatggaaattatgattatttgat
gtatgcagatcttgattttgatcatcctgatgttgcgaatgagatgaaaaattgggaacatggtatgcgaatgaattaaatttagatggctttcgttt
ggacgctgttaaacatattgatcatgaatatttacgcgattgggtaaatcatgccagacagcaaacggggaaagaaatgtttacagtagctgaata
ttggcaaaatgatgttcaggctttaaacaattatttagcgaaagtcaattataatcaatctgtgtttgatgcaccgcttcattacaattttcattatgcttc

FIGURE 16LLL aacaggaaatgggaattatgatatgagaaatatttaaatggaacagtaatgaaaaatcaccctgcactcgcagttactctcgttgagaatcatgat
tctcagcctgggcagtcattggaatctgtagtaagtccgtggtttaagccgctggcatatgcatttattttaactcgtgcagagggctatccttcagtt
ttctatggtgattactatgggacaagcggaaatagtagttatgaaattccagcgttaaaagataaaattgatccaattttgacggcacgaaaaaactt
tgcatatggtacgcagcgtgattatttagaccatccagatgtgattggctggacaagagaaggcgatggtgtacatgctaattctggtttagcgac
attactctcggacggaccaggaggatcaaagtggatggatgttggaaagaataacgctggggaagtatggtacgatattacgggtaatcaaac
aaatactgtaacaattaataaggacggatgggggcagttctatgtaagtggcggctcagtttccatatatgttcagcggtaa SEQ ID NO: 70
Met Leu Lys Arg Ile Thr Val Val Cys Leu Leu Phe Ile Leu Leu Phe Pro Asn Ile Tyr Glu Gly Asn
Lys Ala Glu Ala Ala Thr Val Asn Asn Gly Thr Leu Met Gln Tyr Phe Glu Trp Tyr Ala Pro Asn Asp
Gly Asn His Trp Asn Arg Leu Arg Ser Asp Ala Glu Ser Leu Ala His Lys Gly Ile Thr Ser Val Trp
Ile Pro Pro Ala Tyr Lys Gly Thr Ser Gln Asn Asp Val Gly Tyr Gly Ala Tyr Asp Leu Tyr Asp Leu
Gly Glu Phe Asn Gln Lys Gly Thr Val Arg Thr Lys Tyr Gly Thr Lys Ala Gln Leu Lys Ser Ala Ile
Asp Ala Leu His Lys Gln Asn Ile Asp Val Tyr Gly Asp Val Val Met Asn His Lys Gly Gly Ala Asp
Tyr Thr Glu Thr Val Thr Ala Val Glu Val Asp Arg Asn Asn Arg Asn Ile Glu Val Ser Gly Asp Tyr
Gln Ile Ser Ala Trp Thr Gly Phe Asn Phe Pro Gly Arg Gly Asp Ala Tyr Ser Asn Phe Lys Trp Lys
Trp Tyr His Phe Asp Gly Thr Asp Trp Asp Glu Gly Arg Lys Leu Asn Arg Ile Tyr Lys Phe Arg Gly
Val Asp Lys Ala Trp Asp Trp Glu Val Ser Ser Glu Asn Gly Asn Tyr Asp Tyr Leu Met Tyr Ala Asp
Leu Asp Phe Asp His Pro Asp Val Ala Asn Glu Met Lys Asn Trp Gly Thr Trp Tyr Ala Asn Glu
Leu Asn Leu Asp Gly Phe Arg Leu Asp Ala Val Lys His Ile Asp His Glu Tyr Leu Arg Asp Trp Val
Asn His Ala Arg Gln Gln Thr Gly Lys Glu Met Phe Thr Val Ala Glu Tyr Trp Gln Asn Asp Val Gln
Ala Leu Asn Asn Tyr Leu Ala Lys Val Asn Tyr Asn Gln Ser Val Phe Asp Ala Pro Leu His Tyr Asn
Phe His Tyr Ala Ser Thr Gly Asn Gly Asn Tyr Asp Met Arg Asn Ile Leu Asn Gly Thr Val Met Lys
Asn His Pro Ala Leu Ala Val Thr Leu Val Glu Asn His Asp Ser Gln Pro Gly Gln Ser Leu Glu Ser
Val Val Ser Pro Trp Phe Lys Pro Leu Ala Tyr Ala Phe Ile Leu Thr Arg Ala Glu Gly Tyr Pro Ser
Val Phe Tyr Gly Asp Tyr Tyr Gly Thr Ser Gly Asn Ser Ser Tyr Glu Ile Pro Ala Leu Lys Asp Lys
Ile Asp Pro Ile Leu Thr Ala Arg Lys Asn Phe Ala Tyr Gly Thr Gln Arg Asp Tyr Leu Asp His Pro
Asp Val Ile Gly Trp Thr Arg Glu Gly Asp Gly Val His Ala Asn Ser Gly Leu Ala Thr Leu Leu Ser
Asp Gly Pro Gly Gly Ser Lys Trp Met Asp Val Gly Lys Asn Asn Ala Gly Glu Val Trp Tyr Asp Ile
Thr Gly Asn Gln Thr Asn Thr Val Thr Ile Asn Lys Asp Gly Trp Gly Gln Phe Tyr Val Ser Gly Gly
Ser Val Ser Ile Tyr Val Gln Arg SEQ ID NO: 153
ttgccttcaattaatgcaagcgattgcaaaaaaaagggagataggagtatgaagaggaaaaaatggactgcgttagcactatctttaccactagtt
atgagcttatcaacaaacatacaagcagaaacattacataataataagggtcaaaaggcgcaaacaggaaataaagacggaatttttatgaact
gtatgttaattctttttatgatactgatagcaatggacatggtgatttaaaaggcgtcacaaagaaacttgattatttaaatgatggaaatccaagaac
aaataatgatcttcaaataaaaggtatctggatgatgcctattaacaccctctcctagttatcaaaaatatgatgtaacagattactataatatcgatcct
cagtatgaaatttacaagatttcgttgaactaacaacagaagcgcataaacgcaacgtaaaggtagtatagattcttgttattaatcatacaagc
agtgagcatccttggtttgtcgatgcattaaaaaatgaaaacagtaagtatcgagattactatatttgggctgataaaaatacagacttaaatgaaaa
aggccoatgggtcaacaagtatggcacaaagcgtcgaacggagagtatttctacgcaacgttctgggaagggatgccggacttaaactatga
caaccctaaagtaagagaagaaatgattaaaatcgggaaattttggctcaaacaaggagctgatggctttcgtctagatgcagccatgcacatctt
taaagggcaaacacctgaaggagcaaagaaaaatattgaatggtggaatgaattccgcgacgcgatgagagaaacgaatccaaatacgtatct
agttggtgaaatatgggatcaaccagaagtagttgctccgtattatcaatcgttagattctacatttaacttcgacttagcatataaaatcgttaattcc
gttaaaaatggtactgatcaaggggtagccgcggcagctgttgcaacggatgagttatataaaacatataatccaaataaaattgatggaacgttt
ttaacgaatcatgaccaaaatcgtgtaatgagtgagttaaatggtgatgtaaacaaagcaaaatcagcagcctctattctgttgacactccctggta
atccgttcatttattatggcgaagaaatcggcatgacaggccaaaaaccagatgagttgattcgtgagcctttccgttggtatgaagatgataaag
aaggtcaaacgagctgggagactccagtatataacattgatcataatggtgtttcagttgaagcacaagataaacaaaaagcttctcttctaagcc
attatcgtaaaatgattcgtgttcgtcagcaacacgatgaacttgtcaaaggtaatttagaacctatttctgtcaataattcacaggttgttgcctataat
cgtacgtataaaaataaatcaattcaagtgtaccataatatttcagacaagccggttacattaactgtttcaaacaaaggaaaactgattttttctagt
gaattaggagcaaaaaaggaaaaaatcaacattagtaattccagcgaatacgacagtgctagtaaagtaa

FIGURE 16MMM

SEQ ID NO: 154
Met Pro Ser Ile Asn Ala Ser Asp Cys Lys Lys Lys Gly Asp Arg Ser Met Lys Arg Lys Lys Trp Thr
Ala Leu Ala Leu Ser Leu Pro Leu Val Met Ser Leu Ser Thr Asn Ile Gln Ala Glu Thr Leu His Asn
Asn Lys Gly Gln Lys Ala Gln Thr Gly Asn Lys Asp Gly Ile Phe Tyr Glu Leu Tyr Val Asn Ser Phe
Tyr Asp Thr Asp Ser Asn Gly His Gly Asp Leu Lys Gly Val Thr Lys Lys Leu Asp Tyr Leu Asn
Asp Gly Asn Pro Arg Thr Asn Asn Asp Leu Gln Ile Asn Gly Ile Trp Met Met Pro Ile Asn Thr Ser
Pro Ser Tyr His Lys Tyr Asp Val Thr Asp Tyr Tyr Asn Ile Asp Pro Gln Tyr Gly Ser Leu Gln Asp
Phe Arg Glu Leu Thr Thr Glu Ala His Lys Arg Asn Val Lys Val Val Ile Asp Leu Val Ile Asn His
Thr Ser Ser Glu His Pro Trp Phe Val Asp Ala Leu Lys Asn Lys Asn Ser Lys Tyr Arg Asp Tyr Tyr
Ile Trp Ala Asp Lys Asn Thr Asp Leu Asn Glu Lys Gly Pro Trp Gly Gln Gln Val Trp His Lys Ala
Ser Asn Gly Glu Tyr Phe Tyr Ala Thr Phe Trp Glu Gly Met Pro Asp Leu Asn Tyr Asp Asn Pro Lys
Val Arg Glu Glu Met Ile Lys Ile Gly Lys Phe Trp Leu Lys Gln Gly Ala Asp Gly Phe Arg Leu Asp
Ala Ala Met His Ile Phe Lys Gly Gln Thr Pro Glu Gly Ala Lys Lys Asn Ile Glu Trp Trp Asn Glu
Phe Arg Asp Ala Met Arg Glu Thr Asn Pro Asn Thr Tyr Leu Val Gly Glu Ile Trp Gln Pro Glu
Val Val Ala Pro Tyr Tyr Gln Ser Leu Asp Ser Thr Phe Asn Phe Asp Leu Ala Tyr Lys Ile Val Asn
Ser Val Lys Asn Gly Thr Asp Gln Gly Val Ala Ala Ala Ala Val Ala Thr Asp Glu Leu Tyr Lys Thr
Tyr Asn Pro Asn Lys Ile Asp Gly Thr Phe Leu Thr Asn His Asp Gln Asn Arg Val Met Ser Glu Leu
Asn Gly Asp Val Asn Lys Ala Lys Ser Ala Ala Ser Ile Leu Leu Thr Leu Pro Gly Asn Pro Phe Ile
Tyr Tyr Gly Glu Glu Ile Gly Met Thr Gly Gln Lys Pro Asp Glu Leu Ile Arg Glu Pro Phe Arg Trp
Tyr Glu Asp Asp Lys Glu Gly Gln Thr Ser Trp Glu Thr Pro Val Tyr Asn Ile Asp His Asn Gly Val
Ser Val Glu Ala Gln Asp Lys Gln Lys Ala Ser Leu Leu Ser His Tyr Arg Lys Met Ile Arg Val Arg
Gln Gln His Asp Glu Leu Val Lys Gly Asn Leu Glu Pro Ile Ser Val Asn Asn Ser Gln Val Val Ala
Tyr Asn Arg Thr Tyr Lys Asn Lys Ser Ile Gln Val Tyr His Asn Ile Ser Asp Lys Pro Val Thr Leu
Thr Val Ser Asn Lys Gly Lys Leu Ile Phe Ser Ser Glu Leu Gly Ala Lys Lys Glu Lys Ser Thr Leu
Val Ile Pro Ala Asn Thr Thr Val Leu Val Lys

SEQ ID NO: 155
gtgtcaagaatgtttgcaaaacgattcaaaacctctttactgccgttattcgctggatttttattgctgtttcatttggttctggcaggaccaacggctg
cgaatgctgaaacggctaacaaatcaaatgagcttacagcaccgtcgatcaaaagcggaaccattcttcatgcttggaattggtcgttcaatacgt
taaaacacaatatgaaggatattcatgatgcaggatatacagcgattcagacgtctccgattaaccaagtcaaggaagggaaccaaggaaataa
aaacatgtcgaactggtactggctctatcagccgacatcgtaccaaattggcaaccgttacttaggtactgaacaagaatttaaagaaatgtgtgc
agccgctgaagaatatggcataaaggttattgttgacgcggtcatcaatcataccaccagtgactatgccgcgatttccaatgagattaagagtatt
ccaaactggacacatggaaacacacaaattaaaaactggtctgatcgatgggatgtcacgcagaatgcattgctcgggctgtatgactggaata
cacaaaatacacaagtacagtcctatttgaaacggttcttagaaagagcattgaatgacggggcagacggttttcgatttgatgccgccaaacata
tagagcttccggatgatggcagttacggcagtcaaatttggccgaatatcacaaatacatctgcagagttccaatacggagaaatcctgcaggat
agtgcttcaagaagatgcttcatatgtgaattatgaatgtgacagcgtctaaatatgggcattccataaggtccgcttaaaagaatcgtaatctgag
cgtgtggaatttctccacctatgcatcagatgtgtcttcggacaagctagtgacatgggtagaatcgcatgataagtatgccaatgatgatgaag
agtcgacatggatgagcgatgatgatatccgtttaggctgggcggtgatagcttctcgttcaggcagtacgcctcttttctttccagacctgaggg
aggcggaaatggtgtgagattcccggggaaaagccaaataggcgatcgcgggagtgctttatttgaagatcaggctatcactgcggtcaatag
atttcacaatgtgatggctggacagcctgaggaactctcgaaccccaaatggaaacaaccagatatttatgaatcagcgcggctcacatggcgttg
tgctggcaaatgcaggttcatcctctgtttctatcaatacgccaacaaaattgcctgatggcaggtatgataataaagctggggcaggttcatttca
agtaaatgacggtaaactgacaggcacgatcaatgccaggtctgtggctgtgctttatcctgatgatattgcaaaagcgcctcatgttttccttgag
aattacaaaacaggtgtaacacattctttcaatgatcaactgacgattacactgcgtgcagatgcgaatacaacaaaagccgtttatcaaatcaata
atggaccagagacggcgtttaaggatggagatcaattcacaatcggaaaaggagatccatttggcaaaacatacaccatcatgttaaaaggaac
gaacagtgatggtgtaacgaggaccgaggaatacagttttgttaaaagagatccagcttcggccaaaaccatcggctatcaaaatccgaatcatt
ggagccaggtaaatgcttatatctataaacatgatggggccgggca

SEQ ID NO: 156

FIGURE 16NNN

Val Ser Arg Met Phe Ala Lys Arg Phe Lys Thr Ser Leu Leu Pro Leu Phe Ala Gly Phe Leu Leu Leu
Phe His Leu Val Leu Ala Gly Pro Thr Ala Ala Asn Ala Glu Thr Ala Asn Lys Ser Asn Glu Leu Thr
Ala Pro Ser Ile Lys Ser Gly Thr Ile Leu His Ala Trp Asn Trp Ser Phe Asn Thr Leu Lys His Asn
Met Lys Asp Ile His Asp Ala Gly Tyr Thr Ala Ile Gln Thr Ser Pro Ile Asn Gln Val Lys Glu Gly
Asn Gln Gly Asn Lys Asn Met Ser Asn Trp Tyr Trp Leu Tyr Gln Pro Thr Ser Tyr Gln Ile Gly Asn
Arg Tyr Leu Gly Thr Glu Gln Glu Phe Lys Glu Met Cys Ala Ala Ala Glu Glu Tyr Gly Ile Lys Val
Ile Val Asp Ala Val Ile Asn His Thr Thr Ser Asp Tyr Ala Ala Ile Ser Asn Glu Ile Lys Ser Ile Pro
Asn Trp Thr His Gly Asn Thr Gln Ile Lys Asn Trp Ser Asp Arg Trp Asp Val Thr Gln Asn Ala Leu
Leu Gly Leu Tyr Asp Trp Asn Thr Gln Asn Thr Gln Val Gln Ser Tyr Leu Lys Arg Phe Leu Glu
Arg Ala Leu Asn Asp Gly Ala Asp Gly Phe Arg Phe Asp Ala Ala Lys His Ile Glu Leu Pro Asp Asp
Gly Ser Tyr Gly Ser Gln Phe Trp Pro Asn Ile Thr Asn Thr Ser Ala Glu Phe Gln Tyr Gly Glu Ile
Leu Gln Asp Ser Ala Ser Arg Asp Ala Ser Tyr Ala Asn Tyr Met Asn Val Thr Ala Ser Asn Tyr Gly
His Ser Ile Arg Ser Ala Leu Lys Asn Arg Asn Leu Gly Val Ser Asn Ile Ser His Tyr Ala Ser Asp
Val Ser Ala Asp Lys Leu Val Thr Trp Val Glu Ser His Asp Thr Tyr Ala Asn Asp Asp Glu Glu Ser
Thr Trp Met Ser Asp Asp Asp Ile Arg Leu Gly Trp Ala Val Ile Ala Ser Arg Ser Gly Ser Thr Pro
Leu Phe Phe Ser Arg Pro Glu Gly Gly Gly Asn Gly Val Arg Phe Pro Gly Lys Ser Gln Ile Gly Asp
Arg Gly Ser Ala Leu Phe Glu Asp Gln Ala Ile Thr Ala Val Asn Arg Phe His Asn Val Met Ala Gly
Gln Pro Glu Glu Leu Ser Asn Pro Asn Gly Asn Asn Gln Ile Phe Met Asn Gln Arg Gly Ser His Gly
Val Val Leu Ala Asn Ala Gly Ser Ser Ser Val Ser Ile Asn Thr Pro Thr Lys Leu Pro Asp Gly Arg
Tyr Asp Asn Lys Ala Gly Ala Gly Ser Phe Gln Val Asn Asp Gly Lys Leu Thr Gly Thr Ile Asn Ala
Arg Ser Val Ala Val Leu Tyr Pro Asp Asp Ile Ala Lys Ala Pro His Val Phe Leu Glu Asn Tyr Lys
Thr Gly Val Thr His Ser Phe Asn Asp Gln Leu Thr Ile Thr Leu Arg Ala Asp Ala Asn Thr Thr Lys
Ala Val Tyr Gln Ile Asn Asn Gly Pro Glu Thr Ala Phe Lys Asp Gly Asp Gln Phe Thr Ile Gly Lys
Gly Asp Pro Phe Gly Lys Thr Tyr Thr Ile Met Leu Lys Gly Thr Asn Ser Asp Gly Val Thr Arg Thr
Glu Glu Tyr Ser Phe Val Lys Arg Asp Pro Ala Ser Ala Lys Thr Ile Gly Tyr Gln Asn Pro Asn His
Trp Ser Gln Val Asn Ala Tyr Ile Tyr Lys His Asp Gly Gly Arg Ala

SEQ ID NO: 157
atgcaaacgattgcaaaaaaaggggatgaaacgatgaaagggaaaaaatggacagcattagctctaacactgccgctggctgctagcttatca
acaggcgttcacgccgaaaccgtacataaaggtaaagctccaacagcagataaaaacggtgtctctttatgaggtgtatgtaaactcttttacgat
gcaaataaagatggacatggtgatttaaaaggtcttacacaaaagctggattatttgaatgacggcaattctcataccaaaaatgatcttcaagtaa
acggaatttggatgatgccggtaaaccttctcctagctatcataaatatgatgtaacggactattataacattgatccgcagtacggaaatctgca
agattttcgcaagctgatgaaagaagcagataaacgagacgtaaaggttattatggacctctgttgtgaatcatacaagcagtgaacatccttggtt
tcaagctgcattaaaagataaaaacagcaagtacagagattactatatttgggccgataaaaatactgatttaaatgaaaaaggatcttgggggca
gcaagtatggcataaagctccaaacggagagtattttatggtacgttttgggaaggaatgcctgacttaaattacgataatcccgaagtaagaaa
agaaatgattaacgtcgggaaattttggctaaagcaaggcgttgacgggttccgcttagatgctgcgcttcatattttaaaggtcaaacacctgaa
g[unreadable]c
a[unreadable]a
aggaatcgcgactgcagcagccgcaactgatgagctgttcaaatcatacaatccaaataaaattgacggcattttcttaaccaaccatgaccaaa
atcgcgtcatgagtgagctaagcggcgatgtgaataaagcaaagtcagctgcctctatcttacttacgcttcctggcaacccgtatatttattacgg
tgaagaaattggaatgaccggtgaaaagcctgatgagttaatccgtgaaccgttccgctggtacgaaggcaatggacttggacaaaccagctg
ggaaacatccgtatacaacaaaggcggcaatggtgtgtcagtagagacacaaacaaaacaaaaggattctttgttaaatcattaccgtgaaatga
ttcgcgtgcgtcagcagcatgaagagttagtaaaaggaaccccttcaatctatttcagtagacagtaaagaagtcgttgcctatagccgcacgtata
aaggcaaatcgattagcgtgtatcataatatttcaaatcaaccggtaaaagtatctgtaacagcgaaaggtaaattgattttttgctagtgaaaaaggt
gcaaaaaaagtcaaaaatcagcttgtggttccagctaatacaacggttttaataaaataa SEQ ID NO: 158
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ala Pro Thr
Ala Asp Lys Asn Gly Val Phe Tyr Glu Val Tyr Val Asn Ser Phe Tyr Asp Ala Asn Lys Asp Gly His

FIGURE 160OO

Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly
Gln Thr Pro Gly Gly Ala Lys Lys Asn Ile Val Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Asn Ser Val Lys Ser Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Ser Gly Asp Val Asn Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Arg Trp Tyr Glu Gly Asn Gly Leu Gly Gln Thr
Ser Trp Glu Thr Ser Val Tyr Asn Lys Gly Gly Asn Gly Val Ser Val Glu Thr Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Lys Ser Ile
Ser Val Tyr His Asn Ile Ser Asn Gln Pro Val Lys Val Ser Val Thr Ala Lys Gly Lys Leu Ile Phe Ala
Ser Glu Lys Gly Ala Lys Lys Val Lys Asn Gln Leu Val Val Pro Ala Asn Thr Thr Val Leu Ile Lys

SEQ ID NO: 159
ttgcaaaaaaagggggatgaaacgatgaaagggaaaaaatggacagctttagctctaacactgccgctggctgctagcttatcaacaggcgttc
acgccgaaaccgtacataaaggtaaatctccaacagcagataaaaacggtgtattttatgaggtgtatgtaaactcttttttacgatgcaaataaaga
tggacatggtgatttaaaaggtcttacacaaaagttggattatttaaatgatggcaattctcatacaaagaatgatcttcaagtaaacgggatttggat
gatgccggtcaaccttctcccagctatcataaatatgatgtaacggactattataatattgatccgcagtatggaaatctgcaagattttcgcaaac
tgatgaaagaagcagataaacgagatgtaaaagtcattatggacctcgttgtgaatcatacgagcagtgaacacccttggtttcaagctgcattaa
aagataaaaacagcaagtacagagattactatatctgggctgataaaaataccgacttgaatgaaaaaggatcttggggacagcaagtatggca
taaagctccaaacggagagtattttacggaacgttttgggaaggaatgccggacttaaattacgataatcctgaagtaagaaaagaaatgattaa
cgtaggaaagttttggctaaagcaaggagttgatgggttccgtctagatgctgcgcttcatatttttaaaggccaaacacctgaaggcgctaagaa
aaatctcctgtggtggaatgaatttagagatgcaatgaaaaaggaaaaccctaacgtatatctaacgggtgaagtatgggatcaaccggaagta
gtagctccttactatcaatcgcttgattctttatttaactttgatttagcaggaaagattgtaaactctgtaaaatcaggaaatgatcaaggaatcgcga
ctgcagcagcggcaacggatgaactgttcaaatcatacaatccaaataaaaattgacggtatttt cttaaccaaccatgaccaaaatcgcgtcatga
gtgagctaaacggcgatgtgaataaagcaaagtcagctgcctctatcttacttacgcttcctggcaacccgtatatttattacggtgaagaaatcgg
catgaccggtgaaaagcctgatgagttaatccgtgaaccgttcccctggtacgaaggaaacggacttggacaaaccagctgggaaacacctgt
atataacaaaggcggcaacggcgtgtctgtagaagcacaaacaaaacaaaaggactctttgttaaatcattaccgtgaaatgattcgcgtgcgtc
agcagcacgaagagttagtaaaaggcaacggcttcaatctatttcagtagacagtaaagaagtcgttgcctatagccgtacgtataaaggcaaatcg
attagcgtgtatcataatattcaaatcaacccggctaaaggtatctgtagccagcaaaaggtaaattgattttgctagtgaaaaaggtgctaagaaagt
caaaaatcagcttgtgattccggcgaatacaacggttttaataaaataa SEQ ID NO: 160
Met Gln Lys Lys Gly Asp Glu Thr Met Lys Gly Lys Lys Trp Thr Ala Leu Ala Leu Thr Leu Pro
Leu Ala Ala Ser Leu Ser Thr Gly Val His Ala Glu Thr Val His Lys Gly Lys Ser Pro Thr Ala Asp
Lys Asn Gly Val Phe Tyr Glu Val Tyr Val Asn Ser Phe Tyr Asp Ala Asn Lys Asp Gly His Gly Asp
Leu Lys Gly Leu Thr Gln Lys Leu Asp Tyr Leu Asn Asp Gly Asn Ser His Thr Lys Asn Asp Leu
Gln Val Asn Gly Ile Trp Met Met Pro Val Asn Pro Ser Pro Ser Tyr His Lys Tyr Asp Val Thr Asp
Tyr Tyr Asn Ile Asp Pro Gln Tyr Gly Asn Leu Gln Asp Phe Arg Lys Leu Met Lys Glu Ala Asp
Lys Arg Asp Val Lys Val Ile Met Asp Leu Val Val Asn His Thr Ser Ser Glu His Pro Trp Phe Gln
Ala Ala Leu Lys Asp Lys Asn Ser Lys Tyr Arg Asp Tyr Tyr Ile Trp Ala Asp Lys Asn Thr Asp Leu
Asn Glu Lys Gly Ser Trp Gly Gln Gln Val Trp His Lys Ala Pro Asn Gly Glu Tyr Phe Tyr Gly Thr

FIGURE 16PPP

Phe Trp Glu Gly Met Pro Asp Leu Asn Tyr Asp Asn Pro Glu Val Arg Lys Glu Met Ile Asn Val Gly
Lys Phe Trp Leu Lys Gln Gly Val Asp Gly Phe Arg Leu Asp Ala Ala Leu His Ile Phe Lys Gly Gln
Thr Pro Glu Gly Ala Lys Lys Asn Leu Leu Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Asn Ser Val Lys Ser Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Asn Gly Asp Val Asn Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Pro Trp Tyr Glu Gly Asn Gly Leu Gly Gln Thr
Ser Trp Glu Thr Pro Val Tyr Asn Lys Gly Gly Asn Gly Val Ser Val Glu Ala Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Lys Ser Ile
Ser Val Tyr His Asn Ile Ser Asn Gln Pro Val Lys Val Ser Val Ala Ala Lys Gly Lys Leu Ile Phe Ala
Ser Glu Lys Gly Ala Lys Lys Val Lys Asn Gln Leu Val Ile Pro Ala Asn Thr Thr Val Leu Ile Lys

SEQ ID NO: 161
gtggatccaaagaattgtagtcaatttatgcaaacgattgcaaaaaaaggggatgaaacgatgaaaggaaaaaatggacagctttagctctaa
cactgccgctggctgctagcttatcaacaggtgttcacgccgaaaccgtacataaaggtaaagctccaacagcagataaaaacggtgtcttttat
gaggtatatgtaaactcttttacgatgcaaataaagatggacatggtgatttaaaaggccttacacaaaagttggactatttaaatgacggaaattc
tcatacaaagaatgatcttcaagtaaacgggatttggatgatgccggtcaaccctctcctagctatcataaatatgatgtaacggactattataatat
tgatccgcagtatggaaatctgcaagattttcgcaaacttatgaaagaagcagataaacgagacgtaaaagtcattatggaccttgttgtaatcat
acgagcagtgaacacccttggtttcaagctgcgttgaaagataaaaacagcaagtacagagattactatatttgggctgataaaaatactgacttg
aatgaaaaaggatcttggggacaacaagtatggcataaagctccaaacggagagtattttttacggaacgttctgggaaggaatgcctgacttaa
attacgataaccctgaagtaagaaaagaaatgattaacgtcggaaagttttggctaaaacaaggcgttgacggcttccgcttagatgctgccctc
atatttttaaaggtcaaacgcctgaaggcgctaagaaaaaacattctatggtggaatgagtttagagatgcgatgaaaaaagaaaacccgaacgta
tatctaacgggtgaagtgtgggaccagccagaagtagtagcccccttactatcaatcacttgattctctatttaattttgatttagcaggaaaaattgtc
agctctgtaaaagcaggaaatgatcaaggaatcgccactgcagcagcggcaaactgatgagctgttcaaatcatacaatccaaataaaattgacg
gcatttttcttaaccaaccatgaccaaaatcgcgtcatgagtgagttaagcggcgatgtgaataaagcaaaatcagccgcctctatcttacttacgct
tcctggaaatccgtatatttattacggtgaagaaaattggcatgacaggtgaaaagcctgatgaattaatccgtgaaccgttccgctggtacgaagg
caacggaattggacaaactagctgggaaacacctgtatataacaaaggcggtaacggcgtgtctgtagaagcacaaacaaaacaaaaggatt
ccttgttaaatcattaccgtgaaatgattcgtgtgcgccagcagcacgaagagttagtaaaaggaacgcttcaatccatttcagtagacagtaaag
aagtcgttgcctatagccgcacgtacaaaggcaaatcgattagcgtgtatcataatattttcaaatcaacctgtaaaagtatctgtagcagcgaaag
gtaacttgattttgctagtgaaaaaggtgctaagaaagtcaaaaatcagcttgtgattccggcgaatgcgacggttttaataaaataa SEQ ID NO: 162
Val Asp Pro Lys Asn Cys Ser Gln Phe Met Gln Thr Ile Ala Lys Lys Gly Asp Glu Thr Met Lys Gly
Lys Lys Trp Thr Ala Leu Ala Leu Thr Leu Pro Leu Ala Ala Ser Leu Ser Thr Gly Val His Ala Glu
Thr Val His Lys Gly Lys Ala Pro Thr Ala Asp Lys Asn Gly Val Phe Tyr Glu Val Tyr Val Asn Ser
Phe Tyr Asp Ala Asn Lys Asp Gly His Gly Asp Leu Lys Gly Leu Thr Gln Lys Leu Asp Tyr Leu
Asn Asp Gly Asn Ser His Thr Lys Asn Asp Leu Gln Val Asn Gly Ile Trp Met Met Pro Val Asn Pro
Ser Pro Ser Tyr His Lys Tyr Asp Val Thr Asp Tyr Tyr Asn Ile Asp Pro Gln Tyr Gly Asn Leu Gln
Asp Phe Arg Lys Leu Met Lys Glu Ala Asp Lys Arg Asp Val Lys Val Ile Met Asp Leu Val Val
Asn His Thr Ser Ser Glu His Pro Trp Phe Gln Ala Ala Leu Lys Asp Lys Asn Ser Lys Tyr Arg Asp
Tyr Tyr Ile Trp Ala Asp Lys Asn Thr Asp Leu Asn Glu Lys Gly Ser Trp Gly Gln Gln Val Trp His
Lys Ala Pro Asn Gly Glu Tyr Phe Tyr Gly Thr Phe Trp Glu Gly Met Pro Asp Leu Asn Tyr Asp
Asn Pro Glu Val Arg Lys Glu Met Ile Asn Val Gly Lys Phe Trp Leu Lys Gln Gly Val Asp Gly Phe
Arg Leu Asp Ala Ala Leu His Ile Phe Lys Gly Gln Thr Pro Glu Gly Ala Lys Lys Asn Ile Leu Trp
Trp Asn Glu Phe Arg Asp Ala Met Lys Lys Glu Asn Pro Asn Val Tyr Leu Thr Gly Glu Val Trp
Asp Gln Pro Glu Val Val Ala Pro Tyr Tyr Gln Ser Leu Asp Ser Leu Phe Asn Phe Asp Leu Ala Gly
Lys Ile Val Ser Ser Val Lys Ala Gly Asn Asp Gln Gly Ile Ala Thr Ala Ala Ala Ala Thr Asp Glu

FIGURE 16QQQ

Leu Phe Lys Ser Tyr Asn Pro Asn Lys Ile Asp Gly Ile Phe Leu Thr Asn His Asp Gln Asn Arg Val Met Ser Glu Leu Ser Gly Asp Val Asn Lys Ala Lys Ser Ala Ala Ser Ile Leu Leu Thr Leu Pro Gly Asn Pro Tyr Ile Tyr Tyr Gly Glu Glu Ile Gly Met Thr Gly Glu Lys Pro Asp Glu Leu Ile Arg Glu Pro Phe Arg Trp Tyr Glu Gly Asn Gly Ile Gly Gln Thr Ser Trp Glu Thr Pro Val Tyr Asn Lys Gly Gly Asn Gly Val Ser Val Glu Ala Gln Thr Lys Gln Lys Asp Ser Leu Leu Asn His Tyr Arg Glu Met Ile Arg Val Arg Gln Gln His Glu Glu Leu Val Lys Gly Thr Leu Gln Ser Ile Ser Val Asp Ser Lys Glu Val Val Ala Tyr Ser Arg Thr Tyr Lys Gly Lys Ser Ile Ser Val Tyr His Asn Ile Ser Asn Gln Pro Val Lys Val Ser Val Ala Ala Lys Gly Asn Leu Ile Phe Ala Ser Glu Lys Gly Ala Lys Lys Val Lys Asn Gln Leu Val Ile Pro Ala Asn Ala Thr Val Leu Ile Lys

SEQ ID NO: 163
atggtacgtcccgaacgacgggctgcattggaaccgactatcgaacgactcgcagcacttgaaagacattgggtgacgacggtgtggattccg
ccggcgtacaaaggcacgtcacagaacgatgtcgggtatggggcgtacgatttatacgatctcggcgaattcaaccaaaaagggacgacccg
gacgaagtacgggacgaaagcgcagctccagaccgccatctcgaacttgcgcggtaaagggatcggtgtgtacggcgacgtcgtcatgaat
cacaagggcggggccgattataccgaatccgttcaggcgatcgaggtcaatccgtcgaaccggaaccaagaaacgtccggtgagtatggcat
ctcggcctggactgggttcaacttcgcggggcgcaacaatacatactcgccgttcaaatggcgctggtaccattttgacggtaccgattgggatc
agtcacgcagcttgagccgcatctataagttcaagagcacaggcaaggcgtgggacacggacgtgtcgaacgagaacggcaactatgattat
cttatgtatgccgacgtcgatttcgagcatcccgaggtccgccaagagatgaagaactggggcaaatggtacgccgactcgctcgggctcgac
ggtttccggttggatgcggtcaaacatatcagccactcgtacttgaaggagtggggtgacgagcgtgcgccagacgaccgggaaagagatgttc
acggtcgccgagtattggaagaacgatctcggtgccatcaacgactatctgtataagacgggctacacgcactccgtcttcgatgtgccgctcc
attataacttccaagcggccggtaacggcggcgggtattacgatatgcgcaacatcttgaaaggcaccgtcaccgaacagcatccgtcgctgtc
cgtgacgattgtcgataaccacgactcacagccgggccagtcgctcgagtcgacggtcgccaactggttcaaaccgctcgcctacgcgacga
tcatgacgcgcggtcagggttatccggccctcttctatggagactattatggcacgaaagggacgacgaaccgcgaaatcccgaacatgtcgg
gcacgctccaaccgatttgaaggcacgaaaagacttcgcctacgggacgcagcatgactacctcgatcatcaggacgtcatcggctggacac
gtgaaggtgtgaccgaccgtgccaaatcgggtctcgcgacgattctatcggacggtccgggcggctcgaagtggatgtacgtcggcaaacag
aacgccggcgaggtatggaaagacatgacgaacaacaacgcccgtctcgtcacgatcaatgctgacggctggggtcagttcttcgtcaacgg
aggctcggtctcgatttatacgcaacaataa SEQ ID NO: 164
Met Val Arg Pro Glu Arg Arg Ala Ala Leu Glu Pro Thr Ile Glu Arg Leu Ala Ala Leu Glu Arg His Trp Val Thr Thr Val Trp Ile Pro Pro Ala Tyr Lys Gly Thr Ser Gln Asn Asp Val Gly Tyr Gly Ala Tyr Asp Leu Tyr Asp Leu Gly Glu Phe Asn Gln Lys Gly Thr Thr Arg Thr Lys Tyr Gly Thr Lys Ala Gln Leu Gln Thr Ala Ile Ser Asn Leu Arg Gly Lys Gly Ile Gly Val Tyr Gly Asp Val Val Met Asn His Lys Gly Gly Ala Asp Tyr Thr Glu Ser Val Gln Ala Ile Glu Val Asn Pro Ser Asn Arg Asn Gln Glu Thr Ser Gly Glu Tyr Gly Ile Ser Ala Trp Thr Gly Phe Asn Phe Ala Gly Arg Asn Asn Thr Tyr Ser Pro Phe Lys Trp Arg Trp Tyr His Phe Asp Gly Thr Asp Trp Asp Gln Ser Arg Ser Leu Ser Arg Ile Tyr Lys Phe Lys Ser Thr Gly Lys Ala Trp Asp Thr Asp Val Ser Asn Gly Asp Gly Asn Tyr Asp Tyr Leu Met Tyr Ala Asp Val Asp Phe Glu His Pro Glu Val Arg Gln Glu Met Lys Asn Trp Gly Lys Trp Tyr Ala Asp Ser Leu Gly Leu Asp Gly Phe Arg Leu Asp Ala Val Lys His Ile Ser His Ser Tyr Leu Lys Glu Trp Val Thr Ser Val Arg Gln Thr Gly Lys Glu Met Phe Thr Val Ala Glu Tyr Trp Lys Asn Asp Leu Gly Ala Ile Asn Asp Tyr Leu Tyr Lys Thr Gly Tyr Thr His Ser Val Phe Asp Val Pro Leu His Tyr Asn Phe Gln Ala Ala Gly Asn Gly Gly Gly Tyr Tyr Asp Met Arg Asn Ile Leu Lys Gly Thr Val Thr Glu Gln His Pro Ser Leu Ser Val Thr Ile Val Asp Asn His Asp Ser Gln Pro Gly Gln Ser Leu Glu Ser Thr Val Ala Asn Trp Phe Lys Pro Leu Ala Tyr Ala Thr Ile Met Thr Arg Gly Gln Gly Tyr Pro Ala Leu Phe Tyr Gly Asp Tyr Tyr Gly Thr Lys Gly Thr Thr Asn Arg Glu Ile Pro Asn Met Ser Gly Thr Leu Gln Pro Ile Leu Lys Ala Arg Lys Asp Phe Ala Tyr Gly Thr Gln His Asp Tyr Leu Asp His Gln Asp Val Ile Gly Trp Thr Arg Glu Gly Val Thr Asp Arg Ala Lys Ser Gly Leu Ala Thr Ile Leu Ser Asp Gly Pro Gly Gly Ser Lys Trp Met Tyr Val Gly Lys Gln Asn Ala Gly Glu Val Trp Lys Asp Met Thr Asn Asn Asn Ala Arg Leu Val Thr Ile Asn Ala Asp Gly Trp Gly Gln Phe Phe Val Asn Gly Gly Ser Val Ser Ile Tyr Thr Gln Gln

FIGURE 16RRR

SEQ ID NO: 165
atgcagtatttcgagtggtacgtgccaaatgatggggaacattggaatcgtttgcgtaatgatgctgaaaatttagctcataaaggaattacatctgt
atggataccaccgtatataaaggaacttcacaaaatgatgtagggtatggagtgtatgatgtatatgatttgggagaattcaatcaaaaaggaac
gatacggacaaatatgggacaaaagcacaattaaaatctgcaattgaggctttacataatcaaaatatcgatgtatacggtgatgttgttatgaac
cataaaggtggggcagattatactgaggttgtaacagccgttgaggtagaccgtaacaatcgaaatattgaaacatcgagtgattatcaaatagat
gcgtggacgggatttgattttccaggacgcagggactcctattctaattttaaatggagatggtttcattttgatggaacagattgggatgagggaa
ggaaattaaatagaatttataaatttaaaggcgtaggtaaagcttgggactgggaagtgtctagtgagaatggtaactatgattatttaatgtatgca
gatcttgatttcgatcatcctgaagttgcaaatgaaatgaaaaactggggaacctggtatgcggacgaattaaatttagatggctttcgtttagacg
cagttaaacatattgaccatgagtatcttcgtgattgggtaaatcatgttagaaagcaaacggggaaggaaatgtttacagtagctgaatattggca
aaatgatattcgtactttaaacaattatttagggaaagtaaattataatcaatctgtgttcgatgcacctcttcattataattttcattatgcttcaacagg
gaatggaaattatgatatgaggaatattttaaagggtacggtagtagaaagtcatcctacacttgctgttactcttgttgagaatcatgattctcagcc
tggacagtcattagaatctgttgtgagtccttggtttaagccgttggcctatgcatttatttttaacgcgtgcagaagggtatcctctgttttttatggag
attactatggcacaaatggaaatagtagttatgaaattccaacgttaaaggataaaattgatccaattctgacggcacgaaaaaactttgcatatgg
tacgcaacatgattatttagaccatccagatgtgattggctggacaagagaaggggatagtatacatgctaatctggtttagcaacattaatctctg
atggaccaggaggatcaaaatggatgaatgttggaaagaacaacgcaggggaaatatggtacgatattacgggcaatcaaacaaatactgtaa
cgattaataaagatggatgggggcagttccatgtaaatgggggctctgtttcaatatatgttcagaagtaa SEQ ID NO: 166
Met Gln Tyr Phe Glu Trp Tyr Val Pro Asn Asp Gly Glu His Trp Asn Arg Leu Arg Asn Asp Ala
Glu Asn Leu Ala His Lys Gly Ile Thr Ser Val Trp Ile Pro Pro Val Tyr Lys Gly Thr Ser Gln Asn
Asp Val Gly Tyr Gly Val Tyr Asp Val Tyr Asp Leu Gly Glu Phe Asn Gln Lys Gly Thr Ile Arg Thr
Lys Tyr Gly Thr Lys Ala Gln Leu Lys Ser Ala Ile Glu Ala Leu His Asn Gln Asn Ile Asp Val Tyr
Gly Asp Val Val Met Asn His Lys Gly Gly Ala Asp Tyr Thr Glu Val Val Thr Ala Val Glu Val Asp
Arg Asn Asn Arg Asn Ile Glu Thr Ser Ser Asp Tyr Gln Ile Asp Ala Trp Thr Gly Phe Asp Phe Pro
Gly Arg Arg Asp Ser Tyr Ser Asn Phe Lys Trp Arg Trp Phe His Phe Asp Gly Thr Asp Trp Asp Glu
Gly Arg Lys Leu Asn Arg Ile Tyr Lys Phe Lys Gly Val Gly Lys Ala Trp Asp Trp Glu Val Ser Ser
Glu Asn Gly Asn Tyr Asp Tyr Leu Met Tyr Ala Asp Leu Asp Phe Asp His Pro Glu Val Ala Asn
Glu Met Lys Asn Trp Gly Thr Trp Tyr Ala Asp Glu Leu Asn Leu Asp Gly Phe Arg Leu Asp Ala
Val Lys His Ile Asp His Glu Tyr Leu Arg Asp Trp Val Asn His Val Arg Lys Gln Thr Gly Lys Glu
Met Phe Thr Val Ala Glu Tyr Trp Gln Asn Asp Ile Arg Thr Leu Asn Asn Tyr Leu Gly Lys Val Asn
Tyr Asn Gln Ser Val Phe Asp Ala Pro Leu His Tyr Asn Phe His Tyr Ala Ser Thr Gly Asn Gly Asn
Tyr Asp Met Arg Asn Ile Leu Lys Gly Thr Val Val Glu Ser His Pro Thr Leu Ala Val Thr Leu Val
Glu Asn His Asp Ser Gln Pro Gly Gln Ser Leu Glu Ser Val Val Ser Pro Trp Phe Lys Pro Leu Ala
Tyr Ala Phe Ile Leu Thr Arg Ala Glu Gly Tyr Pro Ser Val Phe Tyr Gly Asp Tyr Tyr Gly Thr Asn
Gly Asn Ser Ser Tyr Glu Ile Pro Thr Leu Lys Asp Lys Ile Asp Pro Ile Leu Thr Ala Arg Lys Asn
Phe Ala Tyr Gly Thr Gln His Asp Tyr Leu Asp His Pro Asp Val Ile Gly Trp Thr Arg Glu Gly Asp
Ser Ile His Ala Asn Ser Gly Leu Ala Thr Leu Ile Ser Asp Gly Pro Gly Gly Ser Lys Trp Met Asn
Val Gly Lys Asn Asn Ala Gly Glu Ile Trp Tyr Asp Ile Thr Gly Asn Gln Thr Asn Thr Val Thr Ile
Asn Lys Asp Gly Trp Gly Gln Phe His Val Asn Gly Gly Ser Val Ser Ile Tyr Val Gln Lys SEQ ID NO: 167
atgcaaacgattgcaaaaaaaggggatgaaacgatgaaagggaaaaaatggacagctttagctctaacactgccgctggctgctagcttatca
acaggcgttcacgccgaaaccgtacataaaggtaaatctccaacagcagataaaaacggtgtatttatgaggtgtatgtaaactcttttttacgatg
caaataaagatggacatggtgatttaaaaggtcttacacaaaagttggattatttaaatgatggcaattctcatacaaagaatgatcttcaagtaaac
gggatttggatgatgccggtcaacccttctcccagctatcataaatatgatgtaacggactattataatattgatccgcagtatggaaatctgcaag
attttcgcaaactgatgaaagaagcagataaaacgagatgtaaaagtcattatggacctcgttgtgaatcatacgagcagtgaacaccccttggtttc
aagctgcattaaaagataaaaacagcaagtacagagattactatatctgggctgataaaaataccgacttgaatgaaaaaggatcttggggaca
gcaagtatggcataaagcccccaaacggagagtattttttacggaacgttttgggaaggaatgccggacttaaattacgataatcctgaagtaagaa
aagaaatgattaacgtaggaaagttttggctaaagcaaggagttgacgggttccgtctagatgctgcgcttcatatttttaaaggccaaacacctg

FIGURE 16SSS aaggcgctaagaaaaatctcctgtggtggaatgaatttagagatgcaatgaaaaaggaaaaccctaacgtatatctaacgggtgaagtatggga
tcaaccggaagtagtagctccttactatcaatcgcttgattctttatttaactttgatttagcaggaaagattgtaaactctgtaaaatcaggaaatgat
caaggaatcgcgactgcagcagcggcaacggatgaactgttcaaatcatacaatccaaataaaattgacggtatttcttaaccaaccatgacca
aaatcgcgtcatgagtgagctaagcggcgatgtgaataaagcaaagtcagctgcctctatcttacttacgcttcctggcaacccgtatatttattac
ggtgaagaaatcggcatgaccggtgaaaagcctgatgagttaatccgtgaaccgttccgctggtacgaaggaaacggacttggacaaaccag
ctgggaaacacctgtatacaacaaaggcggcaacggcgtgtctgtagaagcacaaacaaaacaaaaggactctttgttaaatcattaccgtgaa
atgattcgcgtgcgtcagcagcacgaagagttagtaaaaggaacgcttcaatctatttcagtagacagtaaagaagtcgttgcctatagccgcac
gtataaaggcaaatcgattagcgtgtatcataatatttcaaatcaaccggtaaaagtatctgtagcagcaaaaggtaaattgattttggtagtgaaa
aaggtgctaagaaagtcaaaaatcagcttgtgattccggcgaatacaacggtttaataaaataa SEQ ID NO: 168
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ser Pro Thr
Ala Asp Lys Asn Gly Val Phe Tyr Glu Val Tyr Val Asn Ser Phe Tyr Asp Ala Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly
Gln Thr Pro Glu Gly Ala Lys Lys Asn Leu Leu Trp Trp Asn Glu Phe Arg Asp Ala Met Lys Lys
Glu Asn Pro Asn Val Tyr Leu Thr Gly Glu Val Trp Asp Gln Pro Glu Val Val Ala Pro Tyr Tyr Gln
Ser Leu Asp Ser Leu Phe Asn Phe Asp Leu Ala Gly Lys Ile Val Asn Ser Val Lys Ser Gly Asn Asp
Gln Gly Ile Ala Thr Ala Ala Ala Ala Thr Asp Glu Leu Phe Lys Ser Tyr Asn Pro Asn Lys Ile Asp
Gly Ile Phe Leu Thr Asn His Asp Gln Asn Arg Val Met Ser Glu Leu Ser Gly Asp Val Asn Lys Ala
Lys Ser Ala Ala Ser Ile Leu Leu Thr Leu Pro Gly Asn Pro Tyr Ile Tyr Tyr Gly Glu Glu Ile Gly Met
Thr Gly Glu Lys Pro Asp Glu Leu Ile Arg Glu Pro Phe Arg Trp Tyr Glu Gly Asn Gly Leu Gly Gln
Thr Ser Trp Glu Thr Pro Val Tyr Asn Lys Gly Gly Asn Gly Val Ser Val Glu Ala Gln Thr Lys Gln
Lys Asp Ser Leu Leu Asn His Tyr Arg Glu Met Ile Arg Val Arg Gln Gln His Glu Glu Leu Val Lys
Gly Thr Leu Gln Ser Ile Ser Val Asp Ser Lys Glu Val Val Ala Tyr Ser Arg Thr Tyr Lys Gly Lys
Ser Ile Ser Val Tyr His Asn Ile Ser Asn Gln Pro Val Lys Val Ser Val Ala Ala Lys Gly Lys Leu Ile
Phe Gly Ser Glu Lys Gly Ala Lys Lys Val Lys Asn Gln Leu Val Ile Pro Ala Asn Thr Thr Val Leu
Ile Lys SEQ ID NO: 169
atgaaaacattcaaattaaaaagcactttttaacogctaaccttgctgctcagtgctcctgcctttgotgggcaaaatggcaccatgatgcagtatttt
cattggtatgtacctaatgatggcgcattatggacgcaggttgaaagcaatgctccagcactcgctgaaaacggttttacagcgctctggctacc
gccagcttacaaaggcgcgggcggcagtaatgacgtcggttatggcgtctatgatatgtacgatttaggtgagtttgatcaaaaaggctcagtac
gaaccaaatacggcaccaaggctcagtacatctctgcaatcaatgccgcgcacaacaacaatatccaaatctacggcgatgttgtgtttaaccac
cgaggtggtgctgatgggaagtcgtgggtcgataccaagcgcgttgattgggacaaccgtaacattgaactgggcgacaaatggattgaagct
tgggttgagtttaattttcctggccgcaacgacaaatactcaaacttccattggacttggtatcactttgacggtgttgactgggatgatgccggcaa
agaaaaagcgatctttaaattcaaaggcgaaggaaaagcatgggattgggaagtcagctctgaaaaaggcaattacgactacctaatgtacgc
cgatttagacatggatcatccaagaagttaaacaagagctgaaagattggggtgagtggtacatcaacatgaccggcgttgatggctttagaatg
gatgccgtgaagcacattaaatatcagtatctacaagagtggattgatcatttacgttggaaaacaggcaaagagcttttcaccgttggtgagtatt
ggaattacgacgtaaatcaactgcataactttattactaagacctctggcagtatgtcgttgttcgatgcgccgcttcacatgaacttctacaacgcg
tcaaaatctggcggcaattacgatatgcgccaaatcatgaatggcacgttgatgaaggacaacccagtcaaagctgtgactctcgtagaaaacc
acgatacacagccattcaggcgttagagtcgacagtggattggtggttcaagcctcttgcttacgcattcattttattgcgtgaagaaggttatcc
atcagtgttctacgcagattactacggcgcgcagtacagcgacaaaggctacaacatcaatatggccaaagttccttacattgaagaacttgtaa

FIGURE 16TTT cactgcgtaaagagtatgcgtatggcaaacagaattcttatctcgaccactgggatgtgattggctggacccgagagggcgatgctgaacatcc
aaactcaatggcggtgatcatgagtgatggaccaggtggcaaaaaatggatgtataccggtaagccaagcacgcgctatgtcgacaagctgg
gtatccgaactgaagaagtttggaccgataccaatggctgggcagaatttcctgtcaatggtggttcagtctcggtttgggtgggcgttaagtaa SEQ ID NO: 170
Met Lys Thr Phe Lys Leu Lys Arg Thr Phe Leu Pro Leu Thr Leu Leu Leu Ser Ala Pro Ala Phe Ala
Gly Gln Asn Gly Thr Met Met Gln Tyr Phe His Trp Tyr Val Pro Asn Asp Gly Ala Leu Trp Thr Gln
Val Glu Ser Asn Ala Pro Ala Leu Ala Glu Asn Gly Phe Thr Ala Leu Trp Leu Pro Pro Ala Tyr Lys
Gly Ala Gly Gly Ser Asn Asp Val Gly Tyr Gly Val Tyr Asp Met Tyr Asp Leu Gly Glu Phe Asp
Gln Lys Gly Ser Val Arg Thr Lys Tyr Gly Thr Lys Ala Gln Tyr Ile Ser Ala Ile Asn Ala Ala His
Asn Asn Asn Ile Gln Ile Tyr Gly Asp Val Val Phe Asn His Arg Gly Gly Ala Asp Gly Lys Ser Trp
Val Asp Thr Lys Arg Val Asp Trp Asp Asn Arg Asn Ile Glu Leu Gly Asp Lys Trp Ile Glu Ala Trp
Val Glu Phe Asn Phe Pro Gly Arg Asn Asp Lys Tyr Ser Asn Phe His Trp Thr Trp Tyr His Phe Asp
Gly Val Asp Trp Asp Asp Ala Gly Lys Glu Lys Ala Ile Phe Lys Phe Lys Gly Glu Gly Lys Ala Trp
Asp Trp Glu Val Ser Ser Glu Lys Gly Asn Tyr Asp Tyr Leu Met Tyr Ala Asp Leu Asp Met Asp
His Gln Glu Val Lys Gln Glu Leu Lys Asp Trp Gly Glu Trp Tyr Ile Asn Met Thr Gly Val Asp Gly
Phe Arg Met Asp Ala Val Lys His Ile Lys Tyr Gln Tyr Leu Gln Glu Trp Ile Asp His Leu Arg Trp
Lys Thr Gly Lys Glu Leu Phe Thr Val Gly Glu Tyr Trp Asn Tyr Asp Val Asn Gln Leu His Asn
Phe Ile Thr Lys Thr Ser Gly Ser Met Ser Leu Phe Asp Ala Pro Leu His Met Asn Phe Tyr Asn Ala
Ser Lys Ser Gly Gly Asn Tyr Asp Met Arg Gln Ile Met Asn Gly Thr Leu Met Lys Asp Asn Pro Val
Lys Ala Val Thr Leu Val Glu Asn His Asp Thr Gln Pro Leu Gln Ala Leu Glu Ser Thr Val Asp Trp
Trp Phe Lys Pro Leu Ala Tyr Ala Phe Ile Leu Leu Arg Glu Glu Gly Tyr Pro Ser Val Phe Tyr Ala
Asp Tyr Tyr Gly Ala Gln Tyr Ser Asp Lys Gly Tyr Asn Ile Asn Met Ala Lys Val Pro Tyr Ile Glu
Glu Leu Val Thr Leu Arg Lys Glu Tyr Ala Tyr Gly Lys Gln Asn Ser Tyr Leu Asp His Trp Asp Val
Ile Gly Trp Thr Arg Glu Gly Asp Ala Glu His Pro Asn Ser Met Ala Val Ile Met Ser Asp Gly Pro
Gly Gly Lys Lys Trp Met Tyr Thr Gly Lys Pro Ser Thr Arg Tyr Val Asp Lys Leu Gly Ile Arg Thr
Glu Glu Val Trp Thr Asp Thr Asn Gly Trp Ala Glu Phe Pro Val Asn Gly Gly Ser Val Ser Val Trp
Val Gly Val Lys SEQ ID NO: 171
gtgtatgtaaactcttttttacgatgcaaataaagatggacatggtgatttaaaaggtcttacacaaaagttggattatttaaatgatggcaattctcata
caaagaatgatcttcaagtaaacgggatttggatgatgccggtcaacccttctcccagctatcataaatatgatgtaacggactattataatattgat
ccgcagtatggaaatctgcaagattttcgcaaactgatgaaagaagcagataaacgagatgtaaaagtcattatggacctcgttgtgaatcatac
gagcagtgaacacccttggtttcaagctgcattaaaagataaaaacagcaagtacagagattactatatctgggctgataaaaataccgacttga
atgaaaaaggatcttggggacagcaagtatggcataaagcccaaacggagagtattttacggaacgttttgggaaggaatgccggacttaaa
ttacgataatcctgaagtaagaaaagaaatgattaacgtaggaaagttttggctaaagcaaggagttgacgggttccgtctagatgctgcgcttca
tattttaaaggccaaacaactgaagcgcgctagaaaaatatctcttcgtggaatgaattttagagatgcaatgaataagataaaccctaaggtat
atctaacgggtgaagtatggcatcacgcggacgctgtagctcctaactataaatcgatgattgattcttattttaaactttgatttagcaggaaagattgtaa
actctgtaaaatcaggaaatgatcaaggaatcgcgactgcagcagcggcaacggatgaactgttcaaatcatacaatccaaataaaattgacgg
tattttcttaaccaaccatgaccaaaatcgcgtcatgagtgagctaagcggcgatgtgaataaagcaaagtcagctgcctctatcttacttacgctt
cctggcaacccgtatatttattacggtgaagaaatcggcatgaccggtgaaaagcctgatgagttaatccgtgaaccgttccgctggtacgaagg
aaacggacttggacaaaccagctgggaaacacctgtatacaacaaaggcggcaacggcgtgtctgtagaagcacaaacaaaacaaaaggac
tctttgttaaatcattaccgtgaaatgattcgcgtgcgtcagcagcacgaagagttagtaaaaggaacgcttcaatctatttcagtagacagtaaag
aagtcgttgcctatagccgcacgtataaaggcaaatcgattagcgtgtatcataatatttcaaatcaaccggtaaaagtatctgtagcagcaaaag
gtaaaattgattttttggtagtgaaaaaggtgctaagaaagtcaaaaatcagcttgtgattccggcgaatacaacggttttaataaaataa SEQ ID NO: 172
Val Tyr Val Asn Ser Phe Tyr Asp Ala Asn Lys Asp Gly His Gly Asp Leu Lys Gly Leu Thr Gln
Lys Leu Asp Tyr Leu Asn Asp Gly Asn Ser His Thr Lys Asn Asp Leu Gln Val Asn Gly Ile Trp
Met Met Pro Val Asn Pro Ser Pro Ser Tyr His Lys Tyr Asp Val Thr Asp Tyr Tyr Asn Ile Asp Pro

FIGURE 16UUU

Gln Tyr Gly Asn Leu Gln Asp Phe Arg Lys Leu Met Lys Glu Ala Asp Lys Arg Asp Val Lys Val
Ile Met Asp Leu Val Val Asn His Thr Ser Ser Glu His Pro Trp Phe Gln Ala Ala Leu Lys Asp Lys
Asn Ser Lys Tyr Arg Asp Tyr Tyr Ile Trp Ala Asp Lys Asn Thr Asp Leu Asn Glu Lys Gly Ser Trp
Gly Gln Gln Val Trp His Lys Ala Pro Asn Gly Glu Tyr Phe Tyr Gly Thr Phe Trp Glu Gly Met Pro
Asp Leu Asn Tyr Asp Asn Pro Glu Val Arg Lys Glu Met Ile Asn Val Gly Lys Phe Trp Leu Lys
Gln Gly Val Asp Gly Phe Arg Leu Asp Ala Ala Leu His Ile Phe Lys Gly Gln Thr Pro Glu Gly Ala
Lys Lys Asn Leu Leu Trp Trp Asn Glu Phe Arg Asp Ala Met Lys Lys Glu Asn Pro Asn Val Tyr
Leu Thr Gly Glu Val Trp Asp Gln Pro Glu Val Val Ala Pro Tyr Tyr Gln Ser Leu Asp Ser Leu Phe
Asn Phe Asp Leu Ala Gly Lys Ile Val Asn Ser Val Lys Ser Gly Asn Asp Gln Gly Ile Ala Thr Ala
Ala Ala Ala Thr Asp Glu Leu Phe Lys Ser Tyr Asn Pro Asn Lys Ile Asp Gly Ile Phe Leu Thr Asn
His Asp Gln Asn Arg Val Met Ser Glu Leu Ser Gly Asp Val Asn Lys Ala Lys Ser Ala Ala Ser Ile
Leu Leu Thr Leu Pro Gly Asn Pro Tyr Ile Tyr Tyr Gly Glu Glu Ile Gly Met Thr Gly Glu Lys Pro
Asp Glu Leu Ile Arg Glu Pro Phe Arg Trp Tyr Glu Gly Asn Gly Leu Gly Gln Thr Ser Trp Glu Thr
Pro Val Tyr Asn Lys Gly Gly Asn Gly Val Ser Val Glu Ala Gln Thr Lys Gln Lys Asp Ser Leu Leu
Asn His Tyr Arg Glu Met Ile Arg Val Arg Gln Gln His Glu Glu Leu Val Lys Gly Thr Leu Gln Ser
Ile Ser Val Asp Ser Lys Glu Val Val Ala Tyr Ser Arg Thr Tyr Lys Gly Lys Ser Ile Ser Val Tyr His
Asn Ile Ser Asn Gln Pro Val Lys Val Ser Val Ala Ala Lys Gly Lys Leu Ile Phe Gly Ser Glu Lys
Gly Ala Lys Lys Val Lys Asn Gln Leu Val Ile Pro Ala Asn Thr Thr Val Leu Ile Lys

SEQ ID NO: 173
atgcaaacgattgcaaaaaaaggggatgaaacgatgaaagggaaaaaatggacagctttagctctaacactgccgctggctgctagcttatca
acaggcgttcacgcagaaactgtacataaaggtaaagctccaacagcagataaaaacggtgtttttatgaggtgtatgtaaactcttttttacgatg
caaataaagatggacatggtgatttaaaaggtctgacacaaaagttggattatttaaatgacggcaattctcatacaaagaatgatcttcaagtaaa
cgggatttggatgatgccggtaaaccttctcctagctatcataaatatgatgtaacggactattataacattgatcctcagtacggaagtctgcaa
gatttccgcaaactgatgaaagaagcagataaacgagacgtaaaagttattatggaccttgttgtgaatcatacgagcagtgaacacccttggttt
caagctgcactaaaagataaaaacagcaagtacagagattactatatttgggctgataaaaataccgatttgaatgaaaaaggatcttggggaca
gcaagtatggcataaagctccaaacggagagtattttacggaacgttctgggaaggaatgcctgacttaaattacgataaccctgaagtaagaa
aagaaatgattaacgtcggaaagttttggctaaagcaaggcgttgatggcttccgcttagatgctgcccttcatatctttaaaggtcaaactcctga
aggcgctaagaaaaatctcctgtggtggaatgagtttagagatgcaatgaaaaaagaaaaccctaacgtatatctaacgggtgaagtatgggat
cagccggaagtagtagctccttattatcaatcgcttgattcccctatttaactttgatttagcaggaaaaaattgtcagctctgtaaaagcaggaaatgat
caaggaatcgccactgcagcagcggcaacggatgagctgttcaaatcatacaatccaaataaaattgacggcatttttcttaaccaaccatgacca
aaaccgcgtcatgagtgagctaagcggagatgtgaataaagcaaaatcagctgcttctatcttacttacgcttcctggaaatccgtatatttattacg
gtgaagaaattggcatgaccggtgaaaagcctgatgaattaatccgtgaaccgttccgctggtacgaaggcaacggaattggacaaactagct
gggaaacacctgtatataacaaaggcggcaatggtgtgtctgtagaagcacaaaccaaacaaaaggattctttgttaaatcattaccgtgaaatg
attcgcgtgcgtcagcagcacgaagagttagtaaaaggaacgcttcagtctatttcagtagacagtaaagaagttgtcgcttatagccgtacgtat
aaaggcaactccattagtgtgtatcataatattttcaaatcaacctgtaaaagtatctgtagcggcgaaaggtaaattgattttgctagtgaaaaagg
tgctaaaaaaggedaaaatcagcttgtgattcnggcgaatgagacgattaatataatga SEQ ID NO: 174
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ala Pro Thr
Ala Asp Lys Asn Gly Val Phe Tyr Glu Val Tyr Val Asn Ser Phe Tyr Asp Ala Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Ser Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly

FIGURE 16VVV

Gln Thr Pro Glu Gly Ala Lys Lys Asn Leu Leu Trp Trp Asn Glu Phe Arg Asp Ala Met Lys Lys
Glu Asn Pro Asn Val Tyr Leu Thr Gly Glu Val Trp Asp Gln Pro Glu Val Val Ala Pro Tyr Tyr Gln
Ser Leu Asp Ser Leu Phe Asn Phe Asp Leu Ala Gly Lys Ile Val Ser Ser Val Lys Ala Gly Asn Asp
Gln Gly Ile Ala Thr Ala Ala Ala Ala Thr Asp Glu Leu Phe Lys Ser Tyr Asn Pro Asn Lys Ile Asp
Gly Ile Phe Leu Thr Asn His Asp Gln Asn Arg Val Met Ser Glu Leu Ser Gly Asp Val Asn Lys Ala
Lys Ser Ala Ala Ser Ile Leu Leu Thr Leu Pro Gly Asn Pro Tyr Ile Tyr Tyr Gly Glu Glu Ile Gly Met
Thr Gly Glu Lys Pro Asp Glu Leu Ile Arg Glu Pro Phe Arg Trp Tyr Glu Gly Asn Gly Ile Gly Gln
Thr Ser Trp Glu Thr Pro Val Tyr Asn Lys Gly Gly Asn Gly Val Ser Val Glu Ala Gln Thr Lys Gln
Lys Asp Ser Leu Leu Asn His Tyr Arg Glu Met Ile Arg Val Arg Gln Gln His Glu Glu Leu Val Lys
Gly Thr Leu Gln Ser Ile Ser Val Asp Ser Lys Glu Val Val Ala Tyr Ser Arg Thr Tyr Lys Gly Asn
Ser Ile Ser Val Tyr His Asn Ile Ser Asn Gln Pro Val Lys Val Ser Val Ala Ala Lys Gly Lys Leu Ile
Phe Ala Ser Glu Lys Gly Ala Lys Lys Gly Lys Asn Gln Leu Val Ile Pro Ala Asn Ala Thr Val Leu
Ile Lys

SEQ ID NO: 175
atgaaaaatataatacgactttgtgctgccagcgctatcctcacggtgtcccacgccagttacgccgacgcaattttacacgcgtttaactggcaat
ataccgatgtaaccgccaatgcaaatcaaattgccgcaaatggctttaaaaaagtcctcatttcacccgcaatgaaatccagcggcagtcaatgg
tgggcccgctatcaaccgcaagacttgcgtgtcattgattctccgctgggcaacaaacaagatttagtcgcgatgatcaatgcgctcaacagcgt
tggggtcgacgtgtatgctgacgtggtgcttaaccatatggctaacgagtcatggaagcgcagtgacctgaactacccggggagtgaggtgct
caacgactatcaatcccgcagtgcttactatcaaaggcaaacacttttcggcaatttacaggagaaccttttttccgagaatgatttccatccggca
ggctgtattaccaattggaatgatcctggccacgtccagtattggcgcttgtgcggcggacagggcgatactgggctaccggatctcgatcctaa
tcaatgggttgtgagtcagcagaagagttacttgaacgcactcaaatcaatgggaatcaaaggggttccgtatcgatgcggtcaaacatatgagtc
aatatcaaatagaccaagtgtttaccccagacattaccgctggtatgcatatattcggagaagtcattaccagtggtgggcaaggtgatagcggct
atgaggctttcttgccccttaccttaataataccgatcacgccgcttatgacttcccgctatttgcatcgattcgagccgcgttttcattctctggtgg
gttaaatcagctacacaatccacaagcctatggccaagcgttacaggactcacgtgcgatcacctttacgattacccacgacattccaaccaatg
acggtttccgctaccagatcatggatccaaccgatgaacagctcgcctatgcctacatcttgggcaaagatggaggaacgccacttgtctatagt
gatgacctacctgacagcgaagacaaagacagtggtcgttgggccgatgtgtggcaagatccgaacatgattaacatgcttgccttccacaacg
cgatgcaaggacaaagcatgactgtagtggctagcgatcaatgtaccttgctatttaagcgcggcaagcaaggcgtggtaggaatcaataaatg
tggcgagagtaagtcggtgactgtcgatacttaccagcatgagttaactggtacaccccgtaccaagacgtattgagcggcgacatcaccaca
gtgagttctcgttatcaccaatttgttttgccagcgcgcagtgcaaggatgtggaaactataa SEQ ID NO: 176
Met Lys Asn Ile Ile Arg Leu Cys Ala Ala Ser Ala Ile Leu Thr Val Ser His Ala Ser Tyr Ala Asp Ala
Ile Leu His Ala Phe Asn Trp Gln Tyr Thr Asp Val Thr Ala Asn Ala Asn Gln Ile Ala Ala Asn Gly
Phe Lys Lys Val Leu Ile Ser Pro Ala Met Lys Ser Ser Gly Ser Gln Trp Trp Ala Arg Tyr Gln Pro
Gln Asp Leu Arg Val Ile Asp Ser Pro Leu Gly Asn Lys Gln Asp Leu Val Ala Met Ile Asn Ala Leu
Asn Ser Val Gly Val Asp Val Tyr Ala Asp Val Val Leu Asn His Met Ala Asn Glu Ser Trp Lys Arg
Ser Asp Leu Asn Tyr Pro Gly Ser Glu Val Leu Asn Asp Tyr Gln Ser Arg Ser Ala Tyr Tyr Gln Arg
Gln Thr Leu Phe Gly Asn Leu Gln Glu Asn Leu Phe Ser Glu Asn Asp Phe His Pro Ala Gly Cys Ile
Thr Asn Trp Asn Asp Pro Gly His Val Gln Tyr Trp Arg Leu Cys Gly Gly Gln Gly Asp Thr Gly
Leu Pro Asp Leu Asp Pro Asn Gln Trp Val Val Ser Gln Gln Lys Ser Tyr Leu Asn Ala Leu Lys Ser
Met Gly Ile Lys Gly Phe Arg Ile Asp Ala Val Lys His Met Ser Gln Tyr Gln Ile Asp Gln Val Phe
Thr Pro Asp Ile Thr Ala Gly Met His Ile Phe Gly Glu Val Ile Thr Ser Gly Gly Gln Gly Asp Ser Gly
Tyr Glu Ala Phe Leu Ala Pro Tyr Leu Asn Asn Thr Asp His Ala Ala Tyr Asp Phe Pro Leu Phe Ala
Ser Ile Arg Ala Ala Phe Ser Phe Ser Gly Gly Leu Asn Gln Leu His Asn Pro Gln Ala Tyr Gly Gln
Ala Leu Gln Asp Ser Arg Ala Ile Thr Phe Thr Ile Thr His Asp Ile Pro Thr Asn Asp Gly Phe Arg
Tyr Gln Ile Met Asp Pro Thr Asp Glu Gln Leu Ala Tyr Ala Tyr Ile Leu Gly Lys Asp Gly Gly Thr
Pro Leu Val Tyr Ser Asp Asp Leu Pro Asp Ser Glu Asp Lys Asp Ser Gly Arg Trp Ala Asp Val Trp
Gln Asp Pro Asn Met Ile Asn Met Leu Ala Phe His Asn Ala Met Gln Gly Gln Ser Met Thr Val Val
Ala Ser Asp Gln Cys Thr Leu Leu Phe Lys Arg Gly Lys Gln Gly Val Val Gly Ile Asn Lys Cys Gly

FIGURE 16WWW

Glu Ser Lys Ser Val Thr Val Asp Thr Tyr Gln His Glu Phe Asn Trp Tyr Thr Pro Tyr Gln Asp Val Leu Ser Gly Asp Ile Thr Thr Val Ser Ser Arg Tyr His Gln Phe Val Leu Pro Ala Arg Ser Ala Arg Met Trp Lys Leu

SEQ ID NO: 177
atgaaaacattcaaattaaaacgcactttttaccgctgaccttgctgctcagtgctcctgcctttgctgggcaaaatggcaccatgatgcagtatttt
cattggtacgtacctaatgatggcgcattatggacgcaggttgaaagcaatgctccagtactcgctgaaaacggttttacagcgctctggctacc
gcccgcatacaaaggcgcgggcggcagtaatgacgtcggttatggcgtctatgatatgtacgatttaggtgagtttgaccaaaaaggctcagta
cgaaccaaatacggcaccaaggctcagtacatctctgcaatcaatgccgcgcacaacaacaatatccaaatttacggcgacgttgtgtttaacca
ccgaggtggcgctgatgggaagtcgtgggtcgataccaagcgcgttgattgggacaaccgcaatattgaactgggcgacaaatggattgaag
cttgggttgagtttaattttcctggccgcaacgacaaatactcgaacttccattggacttggtatcactttgacggtgttgactgggatgatgccggc
aaagaaaaagcgatctttaaattcaaaggcgaaggaaaagcatgggattgggaagtcagctctgaaaaaggcaattacgactacctaatgtac
gccgatttagacatggatcacccagaagttaaacaagagctgaaagattgggtgagtggtacatcaacatgaccggcgttgatggctttagaa
tggatgccgtgaagcacattaaatatcagtatctacaagagtggattgatcatttacgttggaaaacaggcaaagagctttcaccgttggtgagta
ttggaattacgacgtaaatcaactgcacaactttattactaagacctctggcagtatgtcgttgttcgatgcgccgcttcacatgaatttctacaacgc
gtcaaaatctggcggcacttacgatatgcgccaaatcatgaatggcacgttgatgaaggacaacccagtcaaagcagtgactctcgtagaaaac
cacgatacgcagccattgcaggcgttagagtcgacagtagattggtggttcaagcctcttgcttacgcattcattttattgcgtgaagaaggttatc
catcggtgttctacgcagattactacggcgcgcagtacagcgacaaaggttacaacattaatatggccaaagtgccttacattgaagaacttgtaa
cactgcgtaaagagtatgcgtatggcaaacagaattcttatctcgaccattgggatgtgattggctggacccgagagggcgatgctgaacatcc
aaactcaatggcggtgatcatgagtgatggaccgggcggcacaaaatggatgtataccggtaagccaagtacgcgctatgtcgacaagctgg
gtatccgaactgaagatgtttggaccgatgccaatggctgggcagaatttcctgtcaatggtggttcagtctcggtttgggtgggcgttaagtaa SEQ ID NO: 178
Met Lys Thr Phe Lys Leu Lys Arg Thr Phe Leu Pro Leu Thr Leu Leu Leu Ser Ala Pro Ala Phe Ala Gly Gln Asn Gly Thr Met Met Gln Tyr Phe His Trp Tyr Val Pro Asn Asp Gly Ala Leu Trp Thr Gln Val Glu Ser Asn Ala Pro Val Leu Ala Glu Asn Gly Phe Thr Ala Leu Trp Leu Pro Pro Ala Tyr Lys Gly Ala Gly Gly Ser Asn Asp Val Gly Tyr Gly Val Tyr Asp Met Tyr Asp Leu Gly Glu Phe Asp Gln Lys Gly Ser Val Arg Thr Lys Tyr Gly Thr Lys Ala Gln Tyr Ile Ser Ala Ile Asn Ala Ala His Asn Asn Asn Ile Gln Ile Tyr Gly Asp Val Val Phe Asn His Arg Gly Gly Ala Asp Gly Lys Ser Trp Val Asp Thr Lys Arg Val Asp Trp Asp Asn Arg Asn Ile Glu Leu Gly Asp Lys Trp Ile Glu Ala Trp Val Glu Phe Asn Phe Pro Gly Arg Asn Asp Lys Tyr Ser Asn Phe His Trp Thr Trp Tyr His Phe Asp Gly Val Asp Trp Asp Asp Ala Gly Lys Glu Lys Ala Ile Phe Lys Phe Lys Gly Glu Gly Lys Ala Trp Asp Trp Glu Val Ser Ser Glu Lys Gly Asn Tyr Asp Tyr Leu Met Tyr Ala Asp Leu Asp Met Asp His Pro Glu Val Lys Gln Glu Leu Lys Asp Trp Gly Glu Trp Tyr Ile Asn Met Thr Gly Val Asp Gly Phe Arg Met Asp Ala Val Lys His Ile Lys Tyr Gln Tyr Leu Gln Glu Trp Ile Asp His Leu Arg Trp Lys Thr Gly Lys Glu Leu Phe Thr Val Gly Glu Tyr Trp Asn Tyr Asp Val Asn Gln Leu His Asn Phe Ile Thr Lys Thr Ser Gly Ser Met Ser Leu Phe Asp Ala Pro Leu His Met Asn Phe Tyr Asn Ala Ser Lys Ser Gly Gly Thr Tyr Asp Met Arg Gln Ile Met Asn Gly Thr Leu Met Lys Asp Asn Pro Val Lys Ala Val Thr Leu Val Glu Asn His Asp Thr Gln Pro Leu Gln Ala Leu Glu Ser Thr Val Asp Trp Trp Phe Lys Pro Leu Ala Tyr Ala Phe Ile Leu Leu Arg Glu Glu Gly Tyr Pro Ser Val Phe Tyr Ala Asp Tyr Tyr Gly Ala Gln Tyr Ser Asp Lys Gly Tyr Asn Ile Asn Met Ala Lys Val Pro Tyr Ile Glu Glu Leu Val Thr Leu Arg Lys Glu Tyr Ala Tyr Gly Lys Gln Asn Ser Tyr Leu Asp His Trp Asp Val Ile Gly Trp Thr Arg Glu Gly Asp Ala Glu His Pro Asn Ser Met Ala Val Ile Met Ser Asp Gly Pro Gly Gly Thr Lys Trp Met Tyr Thr Gly Lys Pro Ser Thr Arg Tyr Val Asp Lys Leu Gly Ile Arg Thr Glu Asp Val Trp Thr Asp Ala Asn Gly Trp Ala Glu Phe Pro Val Asn Gly Gly Ser Val Ser Val Trp Val Gly Val Lys SEQ ID NO: 179
atgaaaacattcaaattaaaacgcactttttaccgctaaccttgctgctcagtgctcctgcctttgccgggcaaaatggcaccatgatgcagtactt
tcattggtacgtacctaatgatggcgcattatggacgcaggttgaaagcaatgctccagcactcgctgaaaacggttttacagcgctctggctacc

FIGURE 16XXX gccagcttacaaaggcgcgggcggcagtaatgatgtcggttatggcgtctacgatatgtacgatttaggtgagtttgatcaaaaaggctcagtac
gaaccaaatacggtaccaaggctcagtacatctctgcaatcaatgctgcgcacaacaacaatatccaaatttacggcgacgttgtgtttaaccatc
gtggtggcgctgatgggaagtcgtgggtcgataccaagcgcgttgattgggacaaccgtaacattgaactgggcgacaaatggattgaagctt
gggttgagtttaattttcctagccgcaacgacaaatactcgaacttccattggacttggtatcactttgacggtgttgactgggatgatgccggcaa
agaaaaagcgatctttaaattcaaaggcgaaggaaaagcatgggattgggaagtcagctctgaaaaaggcaattacgactacctaatgtacgc
cgatttagacatggatcacccagaagttaaacaagagctgaaagattgggtgagtggtacatcaacatgaccggcgttgatggctttagaatg
gatgccgttaagcacattaaatatcagtatctacaagagtggattgatcatttacgttggaaaacaggcaaagagcttttcaccgttggtgagtattg
gaattacgacgtaaatcaactgcataactttattactaagacctctggcagtatgtcgttgttcgatgcgccgcttcacatgaacttctacaacgcgt
caaaatctggcggcaattacgatatgcgccaaatcatgaatggcacgttgatgaaggacaacccagtcaaagctgtgactctcgtagaaaacca
cgatacgcagccattgcaggcgttagagtcgacagtggattggtggttcaagcctcttgcttacgcattcatcttgttgcgtgaagaaggttatcca
tcggtgttctacgcagattactacggcgcgcagtacagcgacaaaggttacaacattaatatggccaaagtgccttacattgaagaacttgtaaca
ctgcgtaaagagtatgcgtatggcaaacagaattcttatctcgaccattgggatgtgattggctggactcgagagggcgatgctgaacatccaaa
ctcaatggcggtgatcatgagtgatggaccgggcggaacaaaatggatgtataccggtaatccaagcacgcgctatgtcgacaagctgggtat
ccgaactgaagatgtttggaccgatgccaatggctgggcagaatttcctgtcaatggtggttcagtctcggtttgggtgggcgttaagtaa SEQ ID NO: 180
Met Lys Thr Phe Lys Leu Lys Arg Thr Phe Leu Pro Leu Thr Leu Leu Leu Ser Ala Pro Ala Phe Ala
Gly Gln Asn Gly Thr Met Met Gln Tyr Phe His Trp Tyr Val Pro Asn Gly Ala Leu Trp Thr Gln
Val Glu Ser Asn Ala Pro Ala Leu Ala Glu Asn Gly Phe Thr Ala Leu Trp Leu Pro Pro Ala Tyr Lys
Gly Ala Gly Gly Ser Asn Asp Val Gly Tyr Gly Val Tyr Asp Met Tyr Asp Leu Gly Glu Phe Asp
Gln Lys Gly Ser Val Arg Thr Lys Tyr Gly Thr Lys Ala Gln Tyr Ile Ser Ala Ile Asn Ala Ala His
Asn Asn Asn Ile Gln Ile Tyr Gly Asp Val Val Phe Asn His Arg Gly Gly Ala Asp Gly Lys Ser Trp
Val Asp Thr Lys Arg Val Asp Trp Asp Asn Arg Asn Ile Glu Leu Gly Asp Lys Trp Ile Glu Ala Trp
Val Glu Phe Asn Phe Pro Ser Arg Asn Asp Lys Tyr Ser Asn Phe His Trp Thr Trp Tyr His Phe Asp
Gly Val Asp Trp Asp Asp Ala Gly Lys Glu Lys Ala Ile Phe Lys Phe Lys Gly Glu Gly Lys Ala Trp
Asp Trp Glu Val Ser Ser Glu Lys Gly Asn Tyr Asp Tyr Leu Met Tyr Ala Asp Leu Asp Met Asp
His Pro Glu Val Lys Gln Glu Leu Lys Asp Trp Gly Glu Trp Tyr Ile Asn Met Thr Gly Val Asp Gly
Phe Arg Met Asp Ala Val Lys His Ile Lys Tyr Gln Tyr Leu Gln Glu Trp Ile Asp His Leu Arg Trp
Lys Thr Gly Lys Glu Leu Phe Thr Val Gly Glu Tyr Trp Asn Tyr Asp Val Asn Gln Leu His Asn
Phe Ile Thr Lys Thr Ser Gly Ser Met Ser Leu Phe Asp Ala Pro Leu His Met Asn Phe Tyr Asn Ala
Ser Lys Ser Gly Gly Asn Tyr Asp Met Arg Gln Ile Met Asn Gly Thr Leu Met Lys Asp Asn Pro Val
Lys Ala Val Thr Leu Val Glu Asn His Asp Thr Gln Pro Leu Gln Ala Leu Glu Ser Thr Val Asp Trp
Trp Phe Lys Pro Leu Ala Tyr Ala Phe Ile Leu Leu Arg Glu Glu Gly Tyr Pro Ser Val Phe Tyr Ala
Asp Tyr Tyr Gly Ala Gln Tyr Ser Asp Lys Gly Tyr Asn Ile Asn Met Ala Lys Val Pro Tyr Ile Glu
Glu Leu Val Thr Leu Arg Lys Glu Tyr Ala Tyr Gly Lys Gln Asn Ser Tyr Leu Asp His Trp Asp Val
Ile Gly Trp Thr Arg Glu Gly Asp Ala Glu His Pro Asn Ser Met Ala Val Ile Met Ser Asp Gly Pro
Gly Gly Thr Lys Trp Met Tyr Thr Gly Asn Pro Ser Thr Arg Tyr Val Asp Lys Leu Gly Ile Arg Thr
Glu Asp Val Trp Thr Asp Ala Asn Gly Trp Ala Glu Phe Pro Val Asn Gly Gly Ser Val Ser Val Trp
Val Gly Val Lys SEQ ID NO: 181
ttgccagaggccttcggcctggccattacgccgtcacatagccggcggggaggttggtgggcgtgtcgcgcggggcagcctgccgatgc
cggtcctccactggccggcgttcatcctcgtccggcgcttcgtcgccggtcatccgaacaagcacaagaaccggagtattgcgatgagccaca
ccctgcgtgccgccgtattggcggcgatcctgctgccgttccccgccctcgctgaccaggccggcaagagcccggccggcgtgcgctacca
cggcggcgacgaaatcatcctccagggcttccactggaacgtcgtccgcgaagcgcccaacgactggtacaacatccttcgccagcaggcct
cgacgatcgccgcggacggcttctcgcgcaatctggatgccggtgccctggcgtgacttctccagctggaccgacggcggcaagtcaggcgg
cggcgaaggctacttctggcacgacttcaacaagaacggccgctacggcagcgacgcccagctgcgccaggccgccggcgcactcggtgg
cgccggggtgaaggtgctctacgatgtggtgcccaatcacatgaaccgcggctatccggacaaggagatcaacctgccggccggccagggc
ttctggcgcaacgactgcaccgacccgggcaactaccccaacgactgcgatgacggtgaccgcttcatcggcggcaagtcggacctgaaca
ccggccatccgcagatctccggcatgtttcgcgacgagcttgccaacctgcgcagcggtacggcgccggcggcttccgcttcgacttcgttc

FIGURE 16YYY gcggctatgcgcccgaacgggtcgacagctggatgagcgacagcgccgacagcagtttctgcgttggcgagctgtggaaaagcccgtccga
gtacccgagctgggactggcgcaacacggcgagctggcagcagatcatcaaggactggtccgaccgggccaagtgcccggtgttcgacttc
gcgctcaaggagcgcatgcagaacggctcggtcgccgactggaagcatggcctcaatggcaaccccggacccgcgctggcgcgaggtggc
ggtgacctttgtcgacaaccacgacaccggctattcgcccgggcagaacggcggccagcaccactgggcgctgcaggacgggctgatccg
ccaggcctacgcctacatcctcaccagcccgggcacgccggtggtgtactggtcgcacatgtacgactgggggctacggcgacttcattcgcca
gctgatccaggtgcggcgcaccgctggcgtgcgcgccgattcggcgatcagcttccacagcggctacagcggcctggtcgctaccgtcagc
ggcagccatcagaccctggtggtggcgctcaactccgatctggccaaccccggccaggtcgccagcggcagcttcagcgaggcggtcaac
gccagcaacggccaggtgcgcgtctggcgcagcggtagcggcgatggcggcggcaatgacggcggcgagggcggtctggtcaatgtgaa
cttccgctgcgacaacggcgtgacgcagatgggcgacagcgtctacgcggtgggcaacgtcagccagctcggcaactggagcccggcctc
cgcggtacggctgaccgacaccagcagctatccgacctggaagggcagcatcgccctgcctgacggtcagaacgtggaatggaagtgcctg
atccgtaacgaggcggacgcgacgctggtgcgccagtggcaatcgggcggcaacaaccaggtccaggccgctgccggcgcgagcacca
gcggctcgttctga SEQ ID NO: 182
Met Pro Glu Ala Phe Gly Leu Ala Ile Thr Pro Ser His Ser Arg Arg Gly Arg Leu Val Gly Val Ser
Arg Gly Gly Ser Leu Pro Met Pro Val Leu His Trp Pro Ala Phe Ile Leu Val Arg Arg Phe Val Ala
Gly His Pro Asn Lys His Lys Asn Arg Ser Ile Ala Met Ser His Thr Leu Arg Ala Ala Val Leu Ala
Ala Ile Leu Leu Pro Phe Pro Ala Leu Ala Asp Gln Ala Gly Lys Ser Pro Ala Gly Val Arg Tyr His
Gly Gly Asp Glu Ile Ile Leu Gln Gly Phe His Trp Asn Val Val Arg Glu Ala Pro Asn Asp Trp Tyr
Asn Ile Leu Arg Gln Gln Ala Ser Thr Ile Ala Ala Asp Gly Phe Ser Ala Ile Trp Met Pro Val Pro Trp
Arg Asp Phe Ser Ser Trp Thr Asp Gly Gly Lys Ser Gly Gly Gly Glu Gly Tyr Phe Trp His Asp Phe
Asn Lys Asn Gly Arg Tyr Gly Ser Asp Ala Gln Leu Arg Gln Ala Ala Gly Ala Leu Gly Gly Ala
Gly Val Lys Val Leu Tyr Asp Val Val Pro Asn His Met Asn Arg Gly Tyr Pro Asp Lys Glu Ile Asn
Leu Pro Ala Gly Gln Gly Phe Trp Arg Asn Asp Cys Thr Asp Pro Gly Asn Tyr Pro Asn Asp Cys
Asp Asp Gly Asp Arg Phe Ile Gly Gly Lys Ser Asp Leu Asn Thr Gly His Pro Gln Ile Tyr Gly Met
Phe Arg Asp Glu Leu Ala Asn Leu Arg Ser Gly Tyr Gly Ala Gly Gly Phe Arg Phe Asp Phe Val
Arg Gly Tyr Ala Pro Glu Arg Val Asp Ser Trp Met Ser Asp Ser Ala Asp Ser Ser Phe Cys Val Gly
Glu Leu Trp Lys Ser Pro Ser Glu Tyr Pro Ser Trp Asp Trp Arg Asn Thr Ala Ser Trp Gln Gln Ile Ile
Lys Asp Trp Ser Asp Arg Ala Lys Cys Pro Val Phe Asp Phe Ala Leu Lys Glu Arg Met Gln Asn
Gly Ser Val Ala Asp Trp Lys His Gly Leu Asn Gly Asn Pro Asp Pro Arg Trp Arg Glu Val Ala Val
Thr Phe Val Asp Asn His Asp Thr Gly Tyr Ser Pro Gly Gln Asn Gly Gly Gln His His Trp Ala Leu
Gln Asp Gly Leu Ile Arg Gln Ala Tyr Ala Tyr Ile Leu Thr Ser Pro Gly Thr Pro Val Val Tyr Trp Ser
His Met Tyr Asp Trp Gly Tyr Gly Asp Phe Ile Arg Gln Leu Ile Gln Val Arg Arg Thr Ala Gly Val
Arg Ala Asp Ser Ala Ile Ser Phe His Ser Gly Tyr Ser Gly Leu Val Ala Thr Val Ser Gly Ser His Gln
Thr Leu Val Val Ala Leu Asn Ser Asp Leu Ala Asn Pro Gly Gln Val Ala Ser Gly Ser Phe Ser Glu
Ala Val Asn Ala Ser Asn Gly Gln Val Arg Val Trp Arg Ser Gly Ser Gly Asp Gly Gly Asn Asp
Gly Gly Glu Gly Gly Leu Val Asn Val Asn Phe Arg Cys Asp Asn Gly Val Thr Gln Met Gly Asp
Ser Val Tyr Ala Val Gly Asn Val Ser Gln Leu Gly Asn Trp Ser Pro Ala Ser Ala Val Arg Leu Thr
Asp Thr Ser Ser Tyr Pro Thr Trp Lys Gly Ser Ile Ala Leu Pro Asp Gly Gln Asn Val Glu Trp Lys
Cys Leu Ile Arg Asn Glu Ala Asp Ala Thr Leu Val Arg Gln Trp Gln Ser Gly Gly Asn Asn Gln Val
Gln Ala Ala Ala Gly Ala Ser Thr Ser Gly Ser Phe SEQ ID NO: 183
atgcaaacgattgcaaaaaaaggggatgaaacgatgaaaggaaaaaatggacagctttagctctaacactgccgctggctgctagcttatca
acaggcgttcacgccgaaaccgtacataaaggtaagtctgaagcaacagataaaaacggtgtcttttatgaggtgtatgtaaactcttttacgata
caaataaagatggacatggtgatttaaaaggtctgacacaaaagttggattatttaaatgacggcaattctcatacaaagaatgatcttcaagtaaa
cgggatttggatgatgccagtcaaccttctcctagctatcataaatatgatgtaacggactattataacattgatcctcagtacggaaatctgcaag
atttcgcaagctgatgaaagaagcagacaaacgagacgtaaaagtcattatggaccttgttgtgaatcatacgagcagcgaacaccctggttt
caagctgcattaaaagataaaaacagcaagtacagagagattactatatttggggctgataaaaaataccgatttgaatgaaaaaggatctggggggca
gcaagtatggcataaagctccaaacggagagtattttacggaacgtttgggaaggaatgcctgacttaaattacgataaaccctgaagtaagaa

FIGURE 16ZZZ aagaaatgattaacgtcggaaagttttggctaaagcaaggcgttaatggcttccgcttagatgctgcgcttcatattttttaaaggtcaaacacctga
aggcgctaagaaaaatatcctgtggtggaatgagtttagagatgcgatgaaaaaagaaaaccctaacgtatatctaacgggtgaagtatgggat
cagcctgaagtggtagctccttactatcaatcgcttgattctttatttaattttgatttagcaggaaaaaattgtcagctctgtaaaagcaggaaatgatc
aaggaatcgccactgcagcagcggcaacagatgaactgttcaaatcatacaatccaaataaaaattgacggcattttcttaaccaaccatgaccaa
aatcgcgtcatgagtgagctgagcggcgatgtgaacaaagcaaaatcagctgcttctatcttacttacgcttcctggcaacccgtatatttattacg
gtgaagaaattggcatgaccggtgaaaagcctgatgagttaatccgtgaaccattccgctggtacgaaggaaacggacttggacaaactagct
gggaaacacctgtatataacaaaggcggcaacggcgtgtctgtagaagtacaaaccaaacaaaaggattctttgttaaatcattatcgtgaaatg
attcgcgtgcgtcagcagcatgaagagttagtaaaaggaacgcttcaatctatttcagtagacagtaaagaagtggttgcctatagtcgcacgtat
aaaggcaactcgattagcgtgtatcataatatttcaaatcaacctgtaaaagtatctgtagcagcgaaaggtaaattgatttttgctagtgaaaaagg
tgctaaaaaagtcaaaaatcagcttgtaattccggctaatacaacggttttaataaaataa SEQ ID NO: 184
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ser Glu Ala
Thr Asp Lys Asn Gly Val Phe Tyr Glu Val Tyr Val Asn Ser Phe Tyr Asp Thr Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asn Gly Phe Arg Leu Asp Ala Ala Leu His Ile Phe Lys Gly
Gln Thr Pro Glu Gly Ala Lys Lys Asn Ile Leu Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Ser Ser Val Lys Ala Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Ser Gly Asp Val Asn Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Arg Trp Tyr Glu Gly Asn Gly Leu Gly Gln Thr
Ser Trp Glu Thr Pro Val Tyr Asn Lys Gly Gly Asn Gly Val Ser Val Glu Val Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Asn Ser Ile
Ser Val Tyr His Asn Ile Ser Asn Gln Pro Val Lys Val Ser Val Ala Ala Lys Gly Lys Leu Ile Phe Ala
Ser Glu Lys Gly Ala Lys Lys Val Lys Asn Gln Leu Val Ile Pro Ala Asn Thr Thr Val Leu Ile Lys SEQ ID NO: 185
atgaaaactgatgaaggtgaaaaaatggacagctttagctgtaacaatgccggtggctgctagcttatcaacaggcgttcacgccgaaactgtac
ataaaggtaaagctccaacagcagataaaaatcggtgtcttttatgaggtgtatgtaaactcttttacgatgcaaataaagatggacatggtgattta
aaaggtcttacacaaaagctggactatttaaatgacggaaattctcatacaaagaatgatcttcaagtaaacgggatttggatgatgccagtcaac
ccttctcctagctatcataaatatgatgtaacggattattataacattgatccgcagtacggaaatctgcaagattttcgcaagctgatgaaagaagc
agacaaacgagacgtaaaagtcattatggaccttgttgtgaatcatacgagcagcgaacacccttggtttcaagctgcgttaaaagataaaaaca
gcaagtacagagattactatatttgggctgataaaaataccgacttgaatgaaaaaggatcttggggacagcaagtatggcataaagctccaaac
ggagagtattttttacggaacgttttgggaaggaatgcctgacttaaattacgataaccctgaagtaagaaaagaaatgattaacgtcggaaagtttt
ggctaaagcaaggcgttgatggcttccgcttagatgctgcgcttcatattttttaaaggtcaaacgcctgaaggcgctaagaaaaatattctgtggt
ggaatgagtttagagatgcgatgaaaaaagaaaaccctaacgtatatctaacgggtgaagtatgggatcagcctgaagtggtagctccttactat
caatcgcttgattccctatttaactttgatttagcaggaaaaattgtcagttctgtaaaagcaggaaatgatcaaggaatcgccactgcagcagcgg
caacggatgagctgttcaaatcatacaatccaaataaaaattgacggcattttcttaaccaaccatgaccaaaaccgcgtcatgagtgaactgatcg
gcgatgtgaacaaagcaaaatcagctgcttctatcttacttacgcttcctggcaacccgtatatttattacggtgaagaaattggcatgaccggtga
aaagcctgatgagttaatccgtgaaccgttccgctggtacgaaggaaacggacttggacaaaccagctgggaaacacctgtatataacaaagg

FIGURE 16AAAA cggcaacggcgtgtctgtagaagcacaaaccaaacaaaaggattctttgttaaatcattaccgtgaaatgattcgcgtgcgtcagcagcatgaag
agttagtaaaaggaacgcttcaatctatttagtagacagtaaagaagttgttgcctatagccgtacgtataaagacaactcgattagcgtgtatcat
aatatttcaaatcaaccggtaaaagtatctgtagcagcaaaaggtaaattaattttgctagtgaaaaaggtgctaaaaaagtcaagaatcagcttg
tgattccggctaatacaacggttttaataaaataa SEQ ID NO: 186
Met Lys Leu Met Lys Gly Lys Lys Trp Thr Ala Leu Ala Leu Thr Leu Pro Leu Ala Ala Ser Leu Ser
Thr Gly Val His Ala Glu Thr Val His Lys Gly Lys Ala Pro Thr Ala Asp Lys Asn Gly Val Phe Tyr
Glu Val Tyr Val Asn Ser Phe Tyr Asp Ala Asn Lys Asp Gly His Gly Asp Leu Lys Gly Leu Thr
Gln Lys Leu Asp Tyr Leu Asn Asp Gly Asn Ser His Thr Lys Asn Asp Leu Gln Val Asn Gly Ile Trp
Met Met Pro Val Asn Pro Ser Pro Ser Tyr His Lys Tyr Asp Val Thr Asp Tyr Tyr Asn Ile Asp Pro
Gln Tyr Gly Asn Leu Gln Asp Phe Arg Lys Leu Met Lys Glu Ala Asp Lys Arg Asp Val Lys Val
Ile Met Asp Leu Val Val Asn His Thr Ser Ser Glu His Pro Trp Phe Gln Ala Ala Leu Lys Asp Lys
Asn Ser Lys Tyr Arg Asp Tyr Tyr Ile Trp Ala Asp Lys Asn Thr Asp Leu Asn Glu Lys Gly Ser Trp
Gly Gln Gln Val Trp His Lys Ala Pro Asn Gly Glu Tyr Phe Tyr Gly Thr Phe Trp Glu Gly Met Pro
Asp Leu Asn Tyr Asp Asn Pro Glu Val Arg Lys Glu Met Ile Asn Val Gly Lys Phe Trp Leu Lys
Gln Gly Val Asp Gly Phe Arg Leu Asp Ala Ala Leu His Ile Phe Lys Gly Gln Thr Pro Glu Gly Ala
Lys Lys Asn Ile Leu Trp Trp Asn Glu Phe Arg Asp Ala Met Lys Lys Glu Asn Pro Asn Val Tyr Leu
Thr Gly Glu Val Trp Asp Gln Pro Glu Val Val Ala Pro Tyr Tyr Gln Ser Leu Asp Ser Leu Phe Asn
Phe Asp Leu Ala Gly Lys Ile Val Ser Ser Val Lys Ala Gly Asn Asp Gln Gly Ile Ala Thr Ala Ala
Ala Ala Thr Asp Glu Leu Phe Lys Ser Tyr Asn Pro Asn Lys Ile Asp Gly Ile Phe Leu Thr Asn His
Asp Gln Asn Arg Val Met Ser Glu Leu Ile Gly Asp Val Asn Lys Ala Lys Ser Ala Ala Ser Ile Leu
Leu Thr Leu Pro Gly Asn Pro Tyr Ile Tyr Tyr Gly Glu Glu Ile Gly Met Thr Gly Glu Lys Pro Asp
Glu Leu Ile Arg Glu Pro Phe Arg Trp Tyr Glu Gly Asn Gly Leu Gly Gln Thr Ser Trp Glu Thr Pro
Val Tyr Asn Lys Gly Gly Asn Gly Val Ser Val Glu Ala Gln Thr Lys Gln Lys Asp Ser Leu Leu Asn
His Tyr Arg Glu Met Ile Arg Val Arg Gln Gln His Glu Glu Leu Val Lys Gly Thr Leu Gln Ser Ile
Leu Val Asp Ser Lys Glu Val Val Ala Tyr Ser Arg Thr Tyr Lys Asp Asn Ser Ile Ser Val Tyr His
Asn Ile Ser Asn Gln Pro Val Lys Val Ser Val Ala Ala Lys Gly Lys Leu Ile Phe Ala Ser Glu Lys
Gly Ala Lys Lys Val Lys Asn Gln Leu Val Ile Pro Ala Asn Thr Thr Val Leu Ile Lys SEQ ID NO: 187
ttgtatctcatccaggaggggcacatgcgttttccgcccattattcacccgcttaccggcctggccgttccggttggagctctgcgtaccgcacag
agctgcggcataggggagtttgccgacttgccggttcttgccgaattctgcaaaaaagccggatttgatcttgtacagcttcttccggtcaatgac
accggcacagaaagttctccatacagcgcgcttctgcctttgccctgcaccgctgtatatcaggctttccgacctgcctgaagcagcgggttc
gaaaagcagattacagatctgaaaagccggtttgaggacttgcctcgtttcagctatacggagctgcgccgtgccaaactggatatcctgcgtgc
agtgtttgataaaaacaaggcaaccatcatcggcagtgccgaactggaagcctggattteagataaccctggatcatcgaatatgcggtttat
gaaccagaaacaccgcaacttgaagccggctggaaacattggaaaagctgcgcaagcactcataaagaaatacaaaaaaccttggag
ggtaaaacctggcaggctgaccatcttatttgcattggctgcgaagatgcggcttgaaccagcagttacttgccgccgctacagaatgcaaagcc
ctgggtgtctatcttaagggcgatatacctataatgatgaacgaggattccgcagatgcctgggcgaatccggaattcttccgtgacgatcttcgg
gccggaagtccccctgacggtgaaaaccccccagggacaaaactggggcttccccatttataactgggaaaaaccttgcaaatgacgggtacag
ctggtggaaaaaacgtctgaagcacagcgcacggtattaccatgcctaccgcattgaccatattcttggttttccggatatgggctataccctat
ggcgaatactccggctacctgggatggccctgccgcatgaaccggtaagtgcagcagaactggcagaacggggcttttccaaggaccgctt
gcgctggcttaccgaaccccacttgcctacacgggcagccgaggaagcgaataactgggactatctgggaacacacggctatctgaatcaga
tcatgaaccgtatcggtgaagaagaactatggctgttcaagcccgagatcacctgcgaggcagatatacgaaacacaaacctgccggatgccc
tgaaagaggttctggtacggcagtggaaaaaccggctgctgcaggttaccggccgcgacgaaaaaggacggacaatctactatccgctgtgg
cgtttccgtgacagcactgcatggcagacgcttaccgatggcgagaaacactccctggaagagctgttcgcccaaaaagcggcgcacaatga
aaccctgtggcgagaacaggcggtggaacttctgggtgagctgacgcgatctacggatatgcttgcctgtgctgaagatctgggaagtattccc
cacagtgtaccggaagtgcttcaaacctttcaatttacagtctgcgggttacccgctgggcccgccaatgggatgccccggccagcccttca
cagactggaggagtatccgctcatgtcggtagcgaccccatcggttcatgattcctctaccctgcgcggatggtgggaaaccgaaggcggcga
ccggggccttttatggacgcatggcctccggaacaggatgcatacgcaggagcaggccgccatgagttcgaaggcgcctggggaccccgcca

Figure 16 (cont.)

FIGURE 16BBBB ggcatcctgggtactccgtaaactctgcgaagcccgttccgcgctctgtgtttccccatccaggatattttggccctgtcttcagactttatgcaat
gacagcggacgaggaacgcatcaatattccgggcagtgtatccggatttaactggacataccggttgcctgcggcaatcgaggatttatctaaa
aacagccaacttataaccgcaatccagaccgcgttgcaggaccgccgggcgaggaaggcacaaggagcacagcaatga SEQ ID NO: 188
Met Tyr Leu Ile Gln Glu Gly His Met Arg Phe Pro Pro Ile Ile His Pro Leu Thr Gly Leu Ala Val Pro
Val Gly Ala Leu Arg Thr Ala Gln Ser Cys Gly Ile Gly Glu Phe Ala Asp Leu Pro Val Leu Ala Glu
Phe Cys Lys Lys Ala Gly Phe Asp Leu Val Gln Leu Leu Pro Val Asn Asp Thr Gly Thr Glu Ser Ser
Pro Tyr Ser Ala Leu Ser Ala Phe Ala Leu His Pro Leu Tyr Ile Arg Leu Ser Asp Leu Pro Glu Ala
Ala Gly Phe Glu Lys Gln Ile Thr Asp Leu Lys Ser Arg Phe Glu Asp Leu Pro Arg Phe Ser Tyr Thr
Glu Leu Arg Arg Ala Lys Leu Asp Ile Leu Arg Ala Val Phe Asp Lys Asn Lys Ala Thr Ile Ile Gly
Ser Ala Glu Leu Glu Ala Trp Ile Ser Asp Asn Pro Trp Ile Ile Glu Tyr Ala Val Phe Met Asn Gln
Lys His Arg Asn Phe Glu Ala Gly Trp Lys His Trp Glu Lys Leu Arg Asn Pro Thr His Asn Glu Ile
Gln Lys Thr Trp Gln Gly Lys Thr Trp Gln Ala Asp His Gln Phe Phe Ala Trp Leu Gln Met Arg Leu
Asp Gln Gln Phe Thr Ala Ala Ala Thr Glu Cys Asn Ala Leu Gly Val Tyr Leu Lys Gly Asp Ile Pro
Ile Met Met Asn Glu Asp Ser Ala Asp Ala Trp Ala Asn Pro Glu Phe Phe Arg Asp Asp Leu Arg
Ala Gly Ser Pro Pro Asp Gly Glu Asn Pro Gln Gly Gln Asn Trp Gly Phe Pro Ile Tyr Asn Trp Glu
Asn Leu Ala Asn Asp Gly Tyr Ser Trp Trp Lys Lys Arg Leu Lys His Ser Ala Arg Tyr Tyr His Ala
Tyr Arg Ile Asp His Ile Leu Gly Phe Phe Arg Ile Trp Ala Ile Pro Tyr Gly Glu Tyr Ser Gly Tyr Leu
Gly Trp Pro Leu Pro His Glu Pro Val Ser Ala Ala Glu Leu Ala Glu Arg Gly Phe Ser Lys Asp Arg
Leu Arg Trp Leu Thr Glu Pro His Leu Pro Thr Arg Ala Ala Glu Glu Ala Asn Asn Trp Asp Tyr Leu
Gly Thr His Gly Tyr Leu Asn Gln Ile Met Asn Arg Ile Gly Glu Glu Glu Leu Trp Leu Phe Lys Pro
Glu Ile Thr Cys Glu Ala Asp Ile Arg Asn Thr Asn Leu Pro Asp Ala Leu Lys Glu Val Leu Val Arg
Gln Trp Lys Asn Arg Leu Leu Gln Val Thr Gly Arg Asp Glu Lys Gly Arg Thr Ile Tyr Tyr Pro Leu
Trp Arg Phe Arg Asp Ser Thr Ala Trp Gln Thr Leu Thr Asp Gly Glu Lys His Ser Leu Glu Glu Leu
Phe Ala Gln Lys Ala Ala His Asn Glu Thr Leu Trp Arg Glu Gln Ala Val Glu Leu Leu Gly Glu Leu
Thr Arg Ser Thr Asp Met Leu Ala Cys Ala Glu Asp Leu Gly Ser Ile Pro His Ser Val Pro Glu Val
Leu Ser Asn Leu Ser Ile Tyr Ser Leu Arg Val Thr Arg Trp Ala Arg Gln Trp Asp Ala Pro Gly Gln
Pro Phe His Arg Leu Glu Glu Tyr Pro Leu Met Ser Val Ala Thr Pro Ser Val His Asp Ser Ser Thr
Leu Arg Gly Trp Trp Glu Thr Glu Gly Gly Asp Arg Ala Phe Met Asp Ala Trp Pro Pro Glu Gln
Asp Ala Tyr Ala Gly Ala Gly Arg His Glu Phe Glu Gly Ala Trp Gly Pro Arg Gln Ala Ser Trp Val
Leu Arg Lys Leu Cys Glu Ala Arg Ser Ala Leu Cys Val Phe Pro Ile Gln Asp Ile Leu Ala Leu Ser
Ser Asp Phe Tyr Ala Met Thr Ala Asp Glu Glu Arg Ile Asn Ile Pro Gly Ser Val Ser Gly Phe Asn
Trp Thr Tyr Arg Leu Pro Ala Ala Ile Glu Asp Leu Ser Lys Asn Ser Gln Leu Ile Thr Ala Ile Gln Thr
Ala Leu Gln Asp Arg Arg Ala Arg Lys Ala Gln Gly Ala Gln Gln SEQ ID NO: 189
atgcaaacgattgcaaaaaaggggatgaaacgatgaaaggcaaaaatggacagctttagctctaacactgccgctggctgctagcttatca
acaggcgttcacgccgaaaccgtacataaaggtaaatctccagctgcagataaaaacggtgtcttttatgaggtgtatgtaaactcttttacgatg
caaataaagatggacatggtgatttaaaaggtcttacacaaaaactggactatttaaatgatggcaattctcatacaaagaatgatcttcaagtaaa
cgggatttggatgatgccgatcaacccttctcctagctatcataaatatgatgtaacggactattataacattgattctcagtacggaaatctgcaag
attttcgcaagctaatgaaagaagcagataaacgagatgtaaaagttattatggacctcgttgtgaatcatacgagcagtgaacaccccttggttca
agctgcgttaaaagataaaaacagcaagtacagagattactatatttgggctgataaaaataccgatttgaatgaaaaaggatcttggggacaac
aagtatggcacaaagctccaaacggagagtattttttacggaacgttctgggaaggaatgcctgacttaaattacgataaccctgaagtaagaaaa
gaaatgattaacgtcggaaagttttggctaaagcaaggcgttgacggcttccgcttagatgctgccttcatatctttaaaggtcaaacacctgaa
ggcgctaagaaaaatattgtgtggtggaatgaatttagagatgcgatgaaaaaagaaaaccccgaacgtatatctaacgggcgaagtatgggatc
agccggaagtggtagctccttattatcagtcgcttgattccctatttaactttgatttagcaggaaaaattgtcagctctgtaaaagcaggaaatgatc
aaggaatcgctactgcagcagcggcaaacagatgaactgttcaaatcatacaatccaaataaaattgacggcattttcttaaccaatcatgaccaaa
atcgcgtcatgagtgagttaagcggagatgtcaataaagcaaagtcagctgcctctatcttacttacgcttcctggaaatccgtatatttattacggt
gaagaaatcggcatgaccggtgaaaagcctgatgaattaatccgtgaaccgttccgctggtacgaaggaaacggacttggacaaactagttgg

FIGURE 16CCCC gaaacacctgtatacaataaaggcggcaacggcgtgtctgtagaagcacaaaccaaacaaaaggactctttgttaaatcattaccgtgaaatgat
tcgcgtgcgtcagcagcacgaagagttagtaaaaggaacgcttcaatctatttcagtagacagtaaagaagttgttgcttatagccgtacgtataa
aggcaactccattagtgtgtatcataatatttcaaatcaacctgtaaaagtatctgtagcagcgaaaggtaaattgattttgctagtgaaaaaggtg
ctaaaaaggtcaaaaatcagcttgtgattccggcgaatacaacggttttagtaaaataa SEQ ID NO: 190
Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ser Pro Ala
Ala Asp Lys Asn Gly Val Phe Tyr Glu Val Tyr Val Asn Ser Phe Tyr Asp Ala Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Ile Asn Pro Ser Pro Ser Tyr His Lys Tyr Asp Val
Thr Asp Tyr Tyr Asn Ile Asp Ser Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly
Gln Thr Pro Glu Gly Ala Lys Lys Asn Ile Val Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Ser Ser Val Lys Ala Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Ser Gly Asp Val Asn Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Arg Trp Tyr Glu Gly Asn Gly Leu Gly Gln Thr
Ser Trp Glu Thr Pro Val Tyr Asn Lys Gly Gly Asn Gly Val Ser Val Glu Ala Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Asn Ser Ile
Ser Val Tyr His Asn Ile Ser Asn Gln Pro Val Lys Val Ser Val Ala Ala Lys Gly Lys Leu Ile Phe Ala
Ser Glu Lys Gly Ala Lys Lys Val Lys Asn Gln Leu Val Ile Pro Ala Asn Thr Thr Val Leu Val Lys SEQ ID NO: 191
atgcaaacgattgcaaaaaaaggggatgaaacgatgaaagggaaaaaatggacagctttagctctaacactgccgctggctgctagcttatca
acaggcgttcacgccgaaaccgtacataaaggtaaatctccaacagcagataaaaacggtgtctttatgaagtgtatgtaaactcttttacgatg
caaataaagatggacatggtgacttaaaaggtcttacacaaaagttggactatttaaatgacggcaattctcatacaaaaaatgatcttcaagtaaa
cgggatttggatgatgccagtcaaccttctcctagctatcataaatatgatgtaacggactattataacattgatccgcagtacggaaatctgcaa
gattttcgcaagctgatgaaagaagcagacaaacgagacgtaaaagtcattatggaccttgttgtgaatcatacgagcagtgaacaccccttggttt
caagctgcgttaaagataaaaacgcaagtacgaggattctatttcggctgataaaatccgtacttgdatgaaaaagcatcttggagdca
acaagtatggtataaagctccaaacggagagtaftttacggtacgttcfggaaggaatgcctgacttaaattadgataaccctgaaglaagaa
aagaaatgattaacgtcggaaagttttggctaaagcaaggcgttgacggttccgcttagatgctgcgcttcatattttaaaggtcaaacagctga
aggcgctaagaaaaatatcctgtggtggaatgagtttagagatgcgatgaaaaaagaaaatccgaatgtatatctaacgggtgaagtatgggat
cagcctgaagtggtagctccttattatcaatcgcttgattctttatttaattttgatttagcaggaaaaattgtcagctctgtaaaagcaggaaatgatc
aaggaatcgccactgcagcagcagcaacagatgaactgttcaaatcatacaatccaaacaaaattgatggcatattcttaaccaaccatgaccaa
aatcgcgtcatgagtgagctgagcggcgatgtgagcaaagcaaaatcagctgcttctatcttacttacgcttcctggcaacccgtatatttattacg
gtgaagaaatcggcatgaccggtgaaaagcctgatgaattaatccgtgaaccgttccgctggtacgaaggaaacggacttggacaaaccagtt
gggaaacacctgtatacaataaaggcggaaacggtgtgtctgtagaagcacaaaccaaacaaaaggattctttgttaaatcattaccgtgaaatg
attcgcgtgcgtcagcagcatgaagagttagtaaaaggaacgcttcaatctatttcagtagacagtaaagaagttgttgcttatagccgtacgtata
aaggcaactccattagtgtgtatcataatatttcaaatcaaccggtaaaagtatctgtagcagcgaaaggtaaattgattttgctagtgaaaaaggt
gctaagaaagtcaaaaatcagcttgtggttccggcgaatacaacggttttaatgaaataa

SEQ ID NO: 192

FIGURE 16DDDD

Met Gln Thr Ile Ala Lys Lys Gly Asp Glu Thr Met Lys Gly Lys Lys Trp Thr Ala Leu Ala Leu Thr
Leu Pro Leu Ala Ala Ser Leu Ser Thr Gly Val His Ala Glu Thr Val His Lys Gly Lys Ser Pro Thr
Ala Asp Lys Asn Gly Val Phe Tyr Glu Val Tyr Val Asn Ser Phe Tyr Asp Ala Asn Lys Asp Gly His
Gly Asp Leu Lys Gly Leu Thr Gln Lys Leu Asp Tyr Leu Asn Asp Gly Asn Ser His Thr Lys Asn
Asp Leu Gln Val Asn Gly Ile Trp Met Met Pro Val Asn Pro Ser Pro Ser Tyr His Lys Tyr Asp Val
Thr Asp Tyr Tyr Asn Ile Asp Pro Gln Tyr Gly Asn Leu Gln Asp Phe Arg Lys Leu Met Lys Glu Ala
Asp Lys Arg Asp Val Lys Val Ile Met Asp Leu Val Val Asn His Thr Ser Ser Glu His Pro Trp Phe
Gln Ala Ala Leu Lys Asp Lys Asn Ser Lys Tyr Arg Asp Tyr Tyr Ile Trp Ala Asp Lys Asn Thr Asp
Leu Asn Glu Lys Gly Ser Trp Gly Gln Gln Val Trp His Lys Ala Pro Asn Gly Glu Tyr Phe Tyr Gly
Thr Phe Trp Glu Gly Met Pro Asp Leu Asn Tyr Asp Asn Pro Glu Val Arg Lys Glu Met Ile Asn Val
Gly Lys Phe Trp Leu Lys Gln Gly Val Asp Gly Phe Arg Leu Asp Ala Ala Leu His Ile Phe Lys Gly
Gln Thr Ala Glu Gly Ala Lys Lys Asn Ile Leu Trp Trp Asn Glu Phe Arg Asp Ala Met Lys Lys Glu
Asn Pro Asn Val Tyr Leu Thr Gly Glu Val Trp Asp Gln Pro Glu Val Val Ala Pro Tyr Tyr Gln Ser
Leu Asp Ser Leu Phe Asn Phe Asp Leu Ala Gly Lys Ile Val Ser Ser Val Lys Ala Gly Asn Asp Gln
Gly Ile Ala Thr Ala Ala Ala Ala Thr Asp Glu Leu Phe Lys Ser Tyr Asn Pro Asn Lys Ile Asp Gly
Ile Phe Leu Thr Asn His Asp Gln Asn Arg Val Met Ser Glu Leu Ser Gly Asp Val Ser Lys Ala Lys
Ser Ala Ala Ser Ile Leu Leu Thr Leu Pro Gly Asn Pro Tyr Ile Tyr Tyr Gly Glu Glu Ile Gly Met Thr
Gly Glu Lys Pro Asp Glu Leu Ile Arg Glu Pro Phe Arg Trp Tyr Glu Gly Asn Gly Leu Gly Gln Thr
Ser Trp Glu Thr Pro Val Tyr Asn Lys Gly Gly Asn Gly Val Ser Val Glu Ala Gln Thr Lys Gln Lys
Asp Ser Leu Leu Asn His Tyr Arg Glu Met Ile Arg Val Arg Gln Gln His Glu Glu Leu Val Lys Gly
Thr Leu Gln Ser Ile Ser Val Asp Ser Lys Glu Val Val Ala Tyr Ser Arg Thr Tyr Lys Gly Asn Ser Ile
Ser Val Tyr His Asn Ile Ser Asn Gln Pro Val Lys Val Ser Val Ala Ala Lys Gly Lys Leu Ile Phe Ala
Ser Glu Lys Gly Ala Lys Lys Val Lys Asn Gln Leu Val Val Pro Ala Asn Thr Thr Val Leu Met Lys

SEQ ID NO: 193
atgaaattcaaaaagagtttatctgccgggctcctttgttcggaggtctgagcggtgtgacaccatccgtcgctgcggaggtgccacgaaccgc
atttgtccatttattcgaatggagttggccggatattgccaccgaatgcgaaaccttctggccctaagggggttctctgcggttcaggtgtctccgc
cgcaaaaaagcgtcagcaatgctgcctggtgggcgcgctaccaacctgttagttactcttttgaagggcgcagtggaacccgggctcaatttgc
ggatatggtccagcgttgtaaagcggtggggtcgatatttatctggatgcggtgatcaaccatatggcagcacaagatcgctatttccagaagt
accttacagcagtaatgattttcacagttgcacgggcgatatcgattattccaaccgctggtcgattcaaaattgcgatctggttgggctgaacgat
ctcaaaaccgagtcagaatacgttcggcagaaaattgcagactatatgaacgatgcgctcagtctgggcgtggcggggtttcggattgatgccg
ccaagcatatcccggccggcgacatcgcggcgatcaagagcaagctcaacggcagcccgtatatctatcaggaggttatcggggcggcagg
ggagccggtacaaaccagcgagtacacgtatattggagacgtgacggaatttaacttcgccggaccatcgggcctaaatttaagcaaggtaat
attaaagacctgcaggggattggttcgtggagcggctggctgagcagcgacgatgcggtgacctttgtgaccaaccatgacgaagaacgcca
taaccctggccaggttctcagccatcaggactttggcaatctgtatttcctcggtaacgtgtttactctggcgtatccttacggctacccaaaagtga
tgtcggggtactacttcagtaattttgatgccgggccaccatcgacaggggtacattctggtaatgcgtgtggctttgatggcggtgattggggtctg
cgaacacaaaggcgtgttgtagcaaacatggtggcgttttgaaacacacagcagcgagtgcagggcatgacatcaatgacgatggtt
acaatcaggtggcgtttggtcgtggtcgggctggacttgtggtgatcaatcgagatgacaattaaggcatcaatcagagtttccagacgtggaat
gcccgctggcgagtattgtgacatcattgccggtgatttcgacacccagagcggtcattgcagcgctacgacgatcaccgtcgacagtcaggg
gtatgcacattttactgtcggtagtcatcaggccgctgcgattcacattggcgcgaaactcggctccgtgtgccaggactgtggcggcacggcc
gcagagacaaaagtctgctttgacaatgcacaaaactttagccaaccgtatttgcattactggaatgtcaatgcggatcaggccgtagcgaatgc
aacctggccgggcgtcgcgatgacggctgaaaatggcggttactgctacgattttggtgtcggtctcaattcacttcaggtaatttcagcgataa
cggcgccagccaaaccgctgatctgaccgccagcagtccgacgttgttaccagaacggaacgtggcgtgacagtgacttctgtcagagta
gcaatgtgggcaacgagagttggtatttccgtggaacctcaaacggttgggggcgtgagcgcactcacttatgaggctgcgacaggcctgtaca
ctacggtgcagagctttaacggggaggagtcgcccgcacgctttaaaattgatgatggcaactggagtgagtcgtatccaagtgctgattatcaa
gtcggtgattatgccacctacacgatcacgtttgacagccagacgaaggccatcaccgtgacttcgcagtaa SEQ ID NO: 194
Met Lys Phe Lys Lys Ser Leu Ser Ala Gly Leu Leu Leu Phe Gly Gly Leu Ser Gly Val Thr Pro Ser
Val Ala Ala Glu Val Pro Arg Thr Ala Phe Val His Leu Phe Glu Trp Ser Trp Pro Asp Ile Ala Thr

FIGURE 16EEEE

Glu Cys Glu Thr Phe Leu Gly Pro Lys Gly Phe Ser Ala Val Gln Val Ser Pro Pro Gln Lys Ser Val
Ser Asn Ala Ala Trp Trp Ala Arg Tyr Gln Pro Val Ser Tyr Ser Phe Glu Gly Arg Ser Gly Thr Arg
Ala Gln Phe Ala Asp Met Val Gln Arg Cys Lys Ala Val Gly Val Asp Ile Tyr Leu Asp Ala Val Ile
Asn His Met Ala Ala Gln Asp Arg Tyr Phe Pro Glu Val Pro Tyr Ser Ser Asn Asp Phe His Ser Cys
Thr Gly Asp Ile Asp Tyr Ser Asn Arg Trp Ser Ile Gln Asn Cys Asp Leu Val Gly Leu Asn Asp Leu
Lys Thr Glu Ser Glu Tyr Val Arg Gln Lys Ile Ala Asp Tyr Met Asn Asp Ala Leu Ser Leu Gly Val
Ala Gly Phe Arg Ile Asp Ala Ala Lys His Ile Pro Ala Gly Asp Ile Ala Ala Ile Lys Ser Lys Leu Asn
Gly Ser Pro Tyr Ile Tyr Gln Glu Val Ile Gly Ala Ala Gly Glu Pro Val Gln Thr Ser Glu Tyr Thr Tyr
Ile Gly Asp Val Thr Glu Phe Asn Phe Ala Arg Thr Ile Gly Pro Lys Phe Lys Gln Gly Asn Ile Lys
Asp Leu Gln Gly Ile Gly Ser Trp Ser Gly Trp Leu Ser Ser Asp Asp Ala Val Thr Phe Val Thr Asn
His Asp Glu Glu Arg His Asn Pro Gly Gln Val Leu Ser His Gln Asp Phe Gly Asn Leu Tyr Phe Leu
Gly Asn Val Phe Thr Leu Ala Tyr Pro Tyr Gly Tyr Pro Lys Val Met Ser Gly Tyr Tyr Phe Ser Asn
Phe Asp Ala Gly Pro Pro Ser Thr Gly Val His Ser Gly Asn Ala Cys Gly Phe Asp Gly Gly Asp Trp
Val Cys Glu His Lys Trp Arg Gly Val Ala Asn Met Val Ala Phe Arg Asn His Thr Ala Ala Gln Trp
Gln Val Thr Asp Trp Trp Asp Asp Gly Tyr Asn Gln Val Ala Phe Gly Arg Gly Gly Leu Gly Phe
Val Val Ile Asn Arg Asp Asp Asn Lys Gly Ile Asn Gln Ser Phe Gln Thr Gly Met Pro Ala Gly Glu
Tyr Cys Asp Ile Ile Ala Gly Asp Phe Asp Thr Gln Ser Gly His Cys Ser Ala Thr Thr Ile Thr Val
Asp Ser Gln Gly Tyr Ala His Phe Thr Val Gly Ser His Gln Ala Ala Ala Ile His Ile Gly Ala Lys Leu
Gly Ser Val Cys Gln Asp Cys Gly Gly Thr Ala Ala Glu Thr Lys Val Cys Phe Asp Asn Ala Gln
Asn Phe Ser Gln Pro Tyr Leu His Tyr Trp Asn Val Asn Ala Asp Gln Ala Val Ala Asn Ala Thr Trp
Pro Gly Val Ala Met Thr Ala Glu Asn Gly Gly Tyr Cys Tyr Asp Phe Gly Val Gly Leu Asn Ser Leu
Gln Val Ile Phe Ser Asp Asn Gly Ala Ser Gln Thr Ala Asp Leu Thr Ala Ser Ser Pro Thr Leu Cys
Tyr Gln Asn Gly Thr Trp Arg Asp Ser Asp Phe Cys Gln Ser Ser Asn Val Gly Asn Glu Ser Trp Tyr
Phe Arg Gly Thr Ser Asn Gly Trp Gly Val Ser Ala Leu Thr Tyr Glu Ala Ala Thr Gly Leu Tyr Thr
Thr Val Gln Ser Phe Asn Gly Glu Glu Ser Pro Ala Arg Phe Lys Ile Asp Asp Gly Asn Trp Ser Glu
Ser Tyr Pro Ser Ala Asp Tyr Gln Val Gly Asp Tyr Ala Thr Tyr Thr Ile Thr Phe Asp Ser Gln Thr
Lys Ala Ile Thr Val Thr Ser Gln

SEQ ID NO: 195
atgctgacagaccgtttctttgatggcgatacatcaaacaacgacccttacaaccagaactacgatgctaaaaacgaccggggaacttatcagg
gcggcgattttaaaggaatcacgcaaaaattggattatctcgataagctaggcgtgaacacaatctggatcagcccgatcgtggaaaatatcaag
catgatgtccgttatgacaactctgaagggcattcatactatgcttaccacggctactgggcaagcaacttcggtgcgttaaacccacacttcggt
acaatggaagatttccatacactgattgacgctgcccatgaaaaaggcatcaagatcatggttgacgtagtattaaaccacactggttatggctta
aaagatatcaacggagaagtttccaatcctccagccggttacccaactgacgcagaacgcagcacatatagcagcctgcttcgccagggttca
aatgtcggctctgatgaggttgttggcgaattagctggcctacctgacttaaaaacagaagaccccgcagtccgccagacaatcatcgactggc
aaacagactggatcacgaaagctactacagctaaaggaaacacaattgactacttccgtgtcgacactgtgaagcacgttgaagacgcaacat
ggatgcattaaaaatgacctcactgaaaaaatgacgaaacaaaaatgatcgggaaagtttgggagcaagtgccaataacaaactagat
accttgaaacaggtatgatggactcactgcttgacttcgacttcaaaggcattgcgcacgattcgtgaacggcaagcttaaggcagaaaacgat
gccctgactgcccgcaacggtaaaattgacaacacagctacttaggttcattccttggaagccatgacgaagatggtttcctatttaaagaagga
aatgacaaaggcaagcttaaggttgctgcttccctgcaagcaacatcaaaaggccagccggtcatctattatggtgaagagcttggtcaaagtg
gagcaaacaactatccgcaatacgataaccgttatgacctggcatgggacaaagttgaaaacaacgacgtccttgagcactacactaaggtcct
gaacttcagaagcgctcattcagaagtgttcgctaaaggtgaacgcgcaacaattggcggttctgacgctgataaaattcttacttttttgctcgtaaa
aatggaaacgaagctgcttacgtcggcttgaacgttgctgacacagcaaaagacgtaacactgactgtttctgcaggtgcagtcgtaactgacc
actatgcagataaaacttatactgcttcagaagctggagaaatcacattgacgatcccggcaaaagctgatggcggtactgttttactaacggttg
aaggcggagaaatcacagctgctaaagcggcaagcgaaggcgacggcacagttgagccagtccctgcgaaccacatccgcattcactacaa
ccgtacagacaacaactatgaaaactacggtgcatggctgtggaacgatgtagcctcccttctgccaactggccgactggcgctacaatgtttg
aaaaaacagacagctacggtgcatacatcgacgtaccacttaaagagggcgctaagaacatcggcttcctcgttatggatgtaacaaaaggtga
tcagggtaaagacggcggcgacaaaggttttacgatctcatcacctgaaatgaacgaaatttggatcaagcaaggttctgacaaggtgtacactt
acgagccagttgatcttccggcgaacactgtccgcgtccactatgtacgtgacaacgcagactacgaaaacttcggtatctggaactggggcga
tgtaacagcaccttccgaaaactggcctacaggcgcagcgaaattcgatggtacagaccgttacggtgcgtatgtcgacattacgctaaaagaa

FIGURE 16FFFF ggcgcaaagaacattggaatgattgctcttaacactgcaaatggagagaaagacggcggagataaatccttcaaccttctggataaatataatcg
catttggattaaacaaggtgatgacaatgtctacgtttctccatactgggagcaggcaacaggaatcaccaatgcagaggtaatctctgaagata
cgattctattaggcttcacaatgactgacggcttaacacctgaatctttaaaaggaggtcttgtaattaaagattcaactggtgctgaagttgccatc
gaaagtgctgaaatcacaagcgcaacctctgtaaaagtaaaagcaacattcgatttagaaaagcttccattatccatcacatacgcaggcagaac
agtttcagcttcaactggctggagaatgcttgatgaaatgtacgcttatgatggaaacgaccttggtgcgacttacaaggacggagcagcgacg
cttaaattatgggctccgaaagcgagcaaggtaaccgctaacttctttgataaaaataatgccgctgaaaaaatcggcagcgtcgagttaacgaa
gggtgaaaaaggagtctggtcagctatggttgctcctggcgacctgaacgtaaccgatcttgaaggttattttaccagtatgatgtaacaaatga
cggtataactcgccaggtgttagatcctatgcaaaatcaatggcagcctttactgtgaatacagaaggcaatgctggtcctgacggggacactg
ttggcaaggcggcaattcaaaaagcttctcgagagtacttctag SEQ ID NO: 196
Met Leu Thr Asp Arg Phe Phe Asp Gly Asp Thr Ser Asn Asn Asp Pro Tyr Asn Gln Asn Tyr Asp
Ala Lys Asn Asp Arg Gly Thr Tyr Gln Gly Gly Asp Phe Lys Gly Ile Thr Gln Lys Leu Asp Tyr Leu
Asp Lys Leu Gly Val Asn Thr Ile Trp Ile Ser Pro Ile Val Glu Asn Ile Lys His Asp Val Arg Tyr Asp
Asn Ser Glu Gly His Ser Tyr Tyr Ala Tyr His Gly Tyr Trp Ala Ser Asn Phe Gly Ala Leu Asn Pro
His Phe Gly Thr Met Glu Asp Phe His Thr Leu Ile Asp Ala Ala His Glu Lys Gly Ile Lys Ile Met
Val Asp Val Val Leu Asn His Thr Gly Tyr Gly Leu Lys Asp Ile Asn Gly Glu Val Ser Asn Pro Pro
Ala Gly Tyr Pro Thr Asp Ala Glu Arg Ser Thr Tyr Ser Ser Leu Leu Arg Gln Gly Ser Asn Val Gly
Ser Asp Glu Val Val Gly Glu Leu Ala Gly Leu Pro Asp Leu Lys Thr Glu Asp Pro Ala Val Arg Gln
Thr Ile Ile Asp Trp Gln Thr Asp Trp Ile Thr Lys Ala Thr Thr Ala Lys Gly Asn Thr Ile Asp Tyr Phe
Arg Val Asp Thr Val Lys His Val Glu Asp Ala Thr Trp Met Ala Phe Lys Asn Asp Leu Thr Glu
Lys Met Pro Thr His Lys Met Ile Gly Glu Ala Trp Gly Ala Ser Ala Asn Asn Gln Leu Gly Tyr Leu
Glu Thr Gly Met Met Asp Ser Leu Leu Asp Phe Asp Phe Lys Gly Ile Ala His Asp Phe Val Asn Gly
Lys Leu Lys Ala Ala Asn Asp Ala Leu Thr Ala Arg Asn Gly Lys Ile Asp Asn Thr Ala Thr Leu Gly
Ser Phe Leu Gly Ser His Asp Glu Asp Gly Phe Leu Phe Lys Glu Gly Asn Asp Lys Gly Lys Leu
Lys Val Ala Ala Ser Leu Gln Ala Thr Ser Lys Gly Gln Pro Val Ile Tyr Tyr Gly Glu Glu Leu Gly
Gln Ser Gly Ala Asn Asn Tyr Pro Gln Tyr Asp Asn Arg Tyr Asp Leu Ala Trp Asp Lys Val Glu
Asn Asn Asp Val Leu Glu His Tyr Thr Lys Val Leu Asn Phe Arg Ser Ala His Ser Glu Val Phe Ala
Lys Gly Glu Arg Ala Thr Ile Gly Gly Ser Asp Ala Asp Lys Phe Leu Leu Phe Ala Arg Lys Asn Gly
Asn Glu Ala Ala Tyr Val Gly Leu Asn Val Ala Asp Thr Ala Lys Asp Val Thr Leu Thr Val Ser Ala
Gly Ala Val Val Thr Asp His Tyr Ala Asp Lys Thr Tyr Thr Ala Ser Glu Ala Gly Glu Ile Thr Leu
Thr Ile Pro Ala Lys Ala Asp Gly Gly Thr Val Leu Leu Thr Val Glu Gly Gly Glu Ile Thr Ala Ala
Lys Ala Ala Ser Glu Gly Asp Gly Thr Val Glu Pro Val Pro Ala Asn His Ile Arg Ile His Tyr Asn
Arg Thr Asp Asn Asn Tyr Glu Asn Tyr Gly Ala Trp Leu Trp Asn Asp Val Ala Ser Pro Ser Ala Asn
Trp Pro Thr Gly Ala Thr Met Phe Glu Lys Thr Asp Ser Tyr Gly Ala Tyr Ile Asp Val Pro Leu Lys
Glu Gly Ala Lys Asn Ile Gly Phe Leu Val Met Asp Val Thr Lys Gly Asp Gln Gly Lys Asp Gly Gly
Asp Lys Gly Phe Thr Ile Ser Ser Pro Glu Met Asn Glu Ile Trp Ile Lys Gln Gly Ser Asp Lys Val
Tyr Thr Tyr Glu Pro Val Asp Leu Pro Ala Asn Thr Val Arg Val His Tyr Val Arg Asp Asn Ala Asp
Tyr Glu Asn Phe Gly Ile Trp Asn Trp Gly Asp Val Thr Ala Pro Ser Glu Asn Trp Pro Thr Gly Ala
Ala Lys Phe Asp Gly Thr Asp Arg Tyr Gly Ala Tyr Val Asp Ile Thr Leu Lys Glu Gly Ala Lys Asn
Ile Gly Met Ile Ala Leu Asn Thr Ala Asn Gly Glu Lys Asp Gly Gly Asp Lys Ser Phe Asn Leu Leu
Asp Lys Tyr Asn Arg Ile Trp Ile Lys Gln Gly Asp Asp Asn Val Tyr Val Ser Pro Tyr Trp Glu Gln
Ala Thr Gly Ile Thr Asn Ala Glu Val Ile Ser Glu Asp Thr Ile Leu Leu Gly Phe Thr Met Thr Asp
Gly Leu Thr Pro Glu Ser Leu Lys Gly Gly Leu Val Ile Lys Asp Ser Thr Gly Ala Glu Val Ala Ile
Glu Ser Ala Glu Ile Thr Ser Ala Thr Ser Val Lys Val Lys Ala Thr Phe Asp Leu Glu Lys Leu Pro
Leu Ser Ile Thr Tyr Ala Gly Arg Thr Val Ser Ala Ser Thr Gly Trp Arg Met Leu Asp Glu Met Tyr
Ala Tyr Asp Gly Asn Asp Leu Gly Ala Thr Tyr Lys Asp Gly Ala Ala Thr Leu Lys Leu Trp Ala Pro
Lys Ala Ser Lys Val Thr Ala Asn Phe Phe Asp Lys Asn Asn Ala Ala Glu Lys Ile Gly Ser Val Glu
Leu Thr Lys Gly Glu Lys Gly Val Trp Ser Ala Met Val Ala Pro Gly Asp Leu Asn Val Thr Asp Leu
Glu Gly Tyr Phe Tyr Gln Tyr Asp Val Thr Asn Asp Gly Ile Thr Arg Gln Val Leu Asp Pro Tyr Ala

FIGURE 16GGGG

Lys Ser Met Ala Ala Phe Thr Val Asn Thr Glu Gly Asn Ala Gly Pro Asp Gly Asp Thr Val Gly Lys Ala Ala Ile Gln Lys Ala Ser Arg Glu Tyr Phe

SEQ ID NO: 197
atgaaaccgtcaaaattcgtttttctctctgctgccatcgcttgcagcctctccagtaccgccaatgctgacgccattttgcatgcatttaactggaag
tactccgacgtcacgcaaaacgcctcgcaaatcgcggcggcgggttataaaaaagtgctgatttcgccagcactgaaatcgagtggcaatgaa
tggtgggcacgttatcaaccgcaagatctgcgcgtgatcgattccccacttggcaacaaaagtgacttaaaatccatgattgatgctctgaaggc
ggtcggcgttgatgtgtatgccgatgtggtgcttaaccatatggccaatgaaacatggaagcgtgaagacttaaattaccctggcagtgaagtgc
tgcaacaatacgcagctaacaccagttattatgcggaccaaacgcttttggcaatttaacggaaaacctattctctggctttgacttccacccaga
aggctgtattagcgattggaatgatgccggcaatgttcagtactggcgtctttgtggcggtgctggtgaccgagggctgccagacttagatccga
acaactgggtggtgtcacagcaacgtttgtatttgaatgcgctaaaaggtttaggtgtgaaaggcttccgcattgatgcggttaaacacatgagcc
aatatcaaatcgaccagattttcactgcagagattaccgccggaatgcacgtgtttggtgaagtgatcaccagtggtggcaaaggcgactccag
ctatgagaacttcttagcgccttatctcaacgccaccaaccattcggcttacgatttcccactgtttgcctctattcgcaacgccttctcctacagcgg
tggcatgaacatgcttcatgatccacaagcctatggccaagggcttgaaaacgcacgttcaattacctttaccatcacgcacgacatcccaacga
acgacggtttccgttatcaaatcatggatccgaaagatgaagagctggcttacgcttatatcctcggtaaagatggcggcacacctctgatttaca
gcgacaacttacctgataacgaagatcgtgataatcgccgttgggaaggtgtttggaaccgtgacctgatgaagaacatgttgcgcttccataac
caaatgcaagggcaagagatgacgatgctgtacagcgaccaatgtctactgatgtttaagcgcggtaaacaagggtggtcggcattaataaat
gcggtgaagagcgttctcataccgttgacacctatcagcatgagttcaactggtatcagcattacacagatacactcactggcgtgactgaaacc
gtgagttcgcgttaccacaccttccgaattccagctcgcagcgcgcgcatgtacatgctctaa SEQ ID NO: 198
Met Lys Pro Ser Lys Phe Val Phe Leu Ser Ala Ala Ile Ala Cys Ser Leu Ser Ser Thr Ala Asn Ala
Asp Ala Ile Leu His Ala Phe Asn Trp Lys Tyr Ser Asp Val Thr Gln Asn Ala Ser Gln Ile Ala Ala
Ala Gly Tyr Lys Lys Val Leu Ile Ser Pro Ala Leu Lys Ser Ser Gly Asn Glu Trp Trp Ala Arg Tyr
Gln Pro Gln Asp Leu Arg Val Ile Asp Ser Pro Leu Gly Asn Lys Ser Asp Leu Lys Ser Met Ile Asp
Ala Leu Lys Ala Val Gly Val Asp Val Tyr Ala Asp Val Val Leu Asn His Met Ala Asn Glu Thr Trp
Lys Arg Glu Asp Leu Asn Tyr Pro Gly Ser Glu Val Leu Gln Gln Tyr Ala Ala Asn Thr Ser Tyr Tyr
Ala Asp Gln Thr Leu Phe Gly Asn Leu Thr Glu Asn Leu Phe Ser Gly Phe Asp Phe His Pro Glu
Gly Cys Ile Ser Asp Trp Asn Asp Ala Gly Asn Val Gln Tyr Trp Arg Leu Cys Gly Gly Ala Gly Asp
Arg Gly Leu Pro Asp Leu Asp Pro Asn Asn Trp Val Val Ser Gln Gln Arg Leu Tyr Leu Asn Ala
Leu Lys Gly Leu Gly Val Lys Gly Phe Arg Ile Asp Ala Val Lys His Met Ser Gln Tyr Gln Ile Asp
Gln Ile Phe Thr Ala Glu Ile Thr Ala Gly Met His Val Phe Gly Glu Val Ile Thr Ser Gly Gly Lys Gly
Asp Ser Ser Tyr Glu Asn Phe Leu Ala Pro Tyr Leu Asn Ala Thr Asn His Ser Ala Tyr Asp Phe Pro
Leu Phe Ala Ser Ile Arg Asn Ala Phe Ser Tyr Ser Gly Gly Met Asn Met Leu His Asp Pro Gln Ala
Tyr Gly Gln Gly Leu Glu Asn Ala Arg Ser Ile Thr Phe Thr Ile Thr His Asp Ile Pro Thr Asn Asp
Gly Phe Arg Tyr Gln Ile Met Asp Pro Lys Asp Glu Glu Leu Ala Tyr Ala Tyr Ile Leu Gly Lys Asp
Gly Gly Thr Pro Leu Ile Tyr Ser Asp Asn Leu Pro Asp Asn Glu Asp Arg Asp Asn Arg Arg Trp
Glu Gly Val Trp Asn Arg Asp Leu Met Lys Asn Met Leu Arg Phe His Asn Gln Met Gln Gly Gln
Glu Met Thr Met Leu Tyr Ser Asp Gln Cys Leu Leu Met Phe Lys Arg Gly Lys Gln Gly Val Val
Gly Ile Asn Lys Cys Gly Glu Glu Arg Ser His Thr Val Asp Thr Tyr Gln His Glu Phe Asn Trp Tyr
Gln Pro Tyr Thr Asp Thr Leu Thr Gly Val Thr Glu Thr Val Ser Ser Arg Tyr His Thr Phe Arg Ile
Pro Ala Arg Ser Ala Arg Met Tyr Met Leu SEQ ID NO: 199
gtgagtttgaccaaaaaggctcagtacgaaccaaatacggcaccaaggctcagtacatctctgcaatcaatgccgcgcacaacaacaatatcca
aatttacggcgatgttgtgtttaaccaccgaggtggtgctgatgggaagtcgtgggtcgataccaagcgcgttgattgggacaaccgcaatattg
aactgggcgacaaatggattgaagcttgggttgagtttaattttcctggccgcaacgacaaatactcgaacttccattggacttggtatcactttgac
ggtgttgactgggatgacgccggcaaagaaaaagcgatctttaaattcaaaggcgaaggaaaagcatgggattgggaagtcagctctgaaaa
aggcaattacgactacctaa

FIGURE 16HHHH

SEQ ID NO: 200
Val Ser Leu Thr Lys Lys Ala Gln Tyr Glu Pro Asn Thr Ala Pro Arg Leu Ser Thr Ser Leu Gln Ser Met Pro Arg Thr Thr Thr Ile Ser Lys Phe Thr Ala Met Leu Cys Leu Thr Thr Glu Val Val Leu Met Gly Ser Arg Gly Ser Ile Pro Ser Ala Leu Ile Gly Thr Thr Ala Ile Leu Asn Trp Ala Thr Asn Gly Leu Lys Leu Gly Leu Ser Leu Ile Phe Leu Ala Ala Thr Thr Asn Thr Arg Thr Ser Ile Gly Leu Gly Ile Thr Leu Thr Val Leu Thr Gly Met Thr Pro Ala Lys Lys Lys Arg Ser Leu Asn Ser Lys Ala Lys Glu Lys His Gly Ile Gly Lys Ser Ala Leu Lys Lys Ala Ile Thr Thr Thr

SEQ ID NO: 201
atgacagccaaggctgatgacttacgcatttaccagatcatggtggaaagctttgtggatggcgataaacaggtcggccatggcaccggctacg
gtaccagccatcacaaaggcgatctgcaagggatcattgactcgctggattacattcaatcgctgggcgtcaatgccatttggctaacgccgattt
ttgaatctattccggtggagggacaagaccattgggcggacaggcttgatgctacaggctactttgccagtgactatttcaagatagaccctcgct
ttggcacgttagaacaagcccgtgagctggtggaaaaggcacacgcgaaaggcttgtatgtcttctttgatggagtatttggtcaccataaaggc
aatgtggtgccatcaccacaaggtagactgcctgtcggtgaaaataacccggtcagctacccagagagcctggcgttttacgaagaagtcgcc
agttactgggtgaaagagttaaagattgatggctggcgtctggatcaagcctatcaagtgccgaccgatgcatggaaagcgatccgtcagagc
gttgatgaagcgtcacagtccgtaacttatgtgaataacaaaggggaaaccgtccatcctttgggttacatggtggctgaaatttggaataacgaa
cgttacatcacagaaaccggttacggcaaagaaggcgatccggcgttgtgctcggcttttgattttccgatgcgtttccgagtggtcgaaaccttt
gcggttaacgaaagtggtgtcagccgaaaaggcggcgaatggttgaatgacggcatgtcactgcacagtcagtatccggatcatgccaagcct
aatttaatgttgggcaaccatgatgtggtgcgctttggggatctgctgcaacgtggcggtattgcgtcaccagaacaaccgcaatactggcagcg
tcataaagcggcgatgtctttcttagcagcgtataccggcccaattaccttgtattacggtgaagaaattggcgatcaggttgacggctttgctaaa
aaaatcaaagaagattgtgccgttattggtttgtgtgatgaccacgtggcgcgcaccagtgcgaagattgatggcgtgacggcgtcactgaatg
cacagcagtctgaactcaaagtatatgtctcttcattgatgacattacgtcagcaacatcctgcgttatcacaaggggaacgtactaatgtgatggc
gacagagacagtatacgtagaccataaacaggcagacaatgaagccctgttgtacatggtgagtacgactgataacgcggagtcagtcaccttt
gaagggcaaagcgattggttcacaaggtgtgctgattgatttgttaacgaacgagcgtttatgcccaataatggggagtatgccattccattaac
gggctttggcgcacgattcctcaagattgacactccgacagcggcgggtgtgatggcgcaatctgctgcctcggtatcgctagtaggtgaagg
gatcatggcccaatgtgataccccaaccgttgaaggcaccggtccggtagcagaaaccttgtacgtggttggcgattttgccgatgctggttgga
agcaaaagccgcagcgcgcgtatcaatacaaaggcaagcacaatggcagcaacttgtatcaagtggttgtcgatgaaaaagcgggcgcctac
aagatgcaatacgccacgaaagattggagcccacagtttactgcagacggtatggcattgaagccgggtaccgcaaagtcgctcatagcgggt
ggctacggtaaagacaccgccgtgacgttgccggaatccggtaagtatgtgtggagcttaacattcagtgatcttggcgagccggagcaaatc
atggtgtctaagtgtcagtaa SEQ ID NO: 202
Met Thr Ala Lys Ala Asp Asp Leu Arg Ile Tyr Gln Ile Met Val Glu Ser Phe Val Asp Gly Asp Lys Gln Val Gly His Gly Thr Gly Tyr Gly Thr Ser His His Lys Gly Asp Leu Gln Gly Ile Ile Asp Ser Leu Asp Tyr Ile Gln Ser Leu Gly Val Asn Ala Ile Trp Leu Thr Pro Ile Phe Glu Ser Ile Pro Val Glu Gly Gln Asp His Trp Ala Asp Arg Leu Asp Ala Thr Gly Tyr Phe Ala Ser Asp Tyr Phe Lys Ile Asp Pro Arg Phe Gly Thr Leu Glu Gln Ala Arg Glu Leu Val Glu Lys Ala His Ala Lys Gly Leu Tyr Val Phe Phe Asp Gly Val Phe Gly His His Lys Gly Asn Val Val Pro Ser Pro Gln Gly Arg Leu Pro Val Gly Glu Asn Asn Pro Val Ser Tyr Pro Glu Ser Leu Ala Phe Tyr Glu Glu Val Ala Ser Tyr Trp Val Lys Glu Leu Lys Ile Asp Gly Trp Arg Leu Asp Gln Ala Tyr Gln Val Pro Thr Asp Ala Trp Lys Ala Ile Arg Gln Ser Val Asp Glu Ala Ser Gln Ser Val Thr Tyr Val Asn Asn Lys Gly Glu Thr Val His Pro Leu Gly Tyr Met Val Ala Glu Ile Trp Asn Asn Glu Arg Tyr Ile Thr Glu Thr Gly Tyr Gly Lys Glu Gly Asp Pro Ala Leu Cys Ser Ala Phe Asp Phe Pro Met Arg Phe Arg Val Val Glu Thr Phe Ala Val Asn Glu Ser Gly Val Ser Arg Lys Gly Gly Glu Trp Leu Asn Asp Gly Met Ser Leu His Ser Gln Tyr Pro Asp His Ala Lys Pro Asn Leu Met Leu Gly Asn His Asp Val Val Arg Phe Gly Asp Leu Leu Gln Arg Gly Gly Ile Ala Ser Pro Glu Gln Pro Gln Tyr Trp Gln Arg His Lys Ala Ala Met Ser Phe Leu Ala Ala Tyr Thr Gly Pro Ile Thr Leu Tyr Tyr Gly Glu Glu Ile Gly Asp Gln Val Asp Gly Phe Ala Lys Lys Ile Lys Glu Asp Cys Ala Val Ile Gly Leu Cys Asp Asp His Val Ala Arg Thr Ser Ala Lys Ile Asp Gly Val Thr Ala Ser Leu Asn Ala Gln Gln Ser Glu Leu Lys Val Tyr Val Ser Ser Leu Met Thr Leu Arg Gln Gln His Pro Ala Leu Ser Gln Gly Glu Arg Thr Asn Val Met Ala Thr Glu

FIGURE 16IIII

Thr Val Tyr Val Asp His Lys Gln Ala Asp Asn Glu Ala Leu Leu Tyr Met Val Ser Thr Thr Asp Asn
Ala Glu Ser Val Thr Leu Lys Gly Lys Ala Ile Gly Ser Gln Gly Val Leu Ile Asp Leu Leu Thr Asn
Glu Arg Phe Met Pro Asn Asn Gly Glu Tyr Ala Ile Pro Leu Thr Gly Phe Gly Ala Arg Phe Leu Lys
Ile Asp Thr Pro Thr Ala Ala Gly Val Met Ala Gln Ser Ala Ala Ser Val Ser Leu Val Gly Glu Gly Ile
Met Ala Gln Cys Asp Thr Pro Thr Val Glu Gly Thr Gly Pro Val Ala Glu Thr Leu Tyr Val Val Gly
Asp Phe Ala Asp Ala Gly Trp Lys Gln Lys Pro Gln Arg Ala Tyr Gln Tyr Lys Gly Lys His Asn Gly
Ser Asn Leu Tyr Gln Val Val Val Asp Glu Lys Ala Gly Ala Tyr Lys Met Gln Tyr Ala Thr Lys Asp
Trp Ser Pro Gln Phe Thr Ala Asp Gly Met Ala Leu Lys Pro Gly Thr Ala Lys Ser Leu Ile Ala Gly
Gly Tyr Gly Lys Asp Thr Ala Val Thr Leu Pro Glu Ser Gly Lys Tyr Val Trp Ser Leu Thr Phe Ser
Asp Leu Gly Glu Pro Glu Gln Ile

SEQ ID NO: 203
atgaagatgaagtcccgggcgtggttgttaggtagtgcagtggccatggcgttggcctcttcggcagccaatgccggtgtcatggttcacctgtt
ccagtggaagtacaatgacatcgccaacgagtgcgaaaaggtgctcggtcccaaagggtatgaagcagtgcagatcacgccgcctgctgaa
cacctgcaaggctcctcctggtgggtggtctatcagcccgtcagctacaagaacttcacttctctgggcggtaacgaggccgaactcaaaagca
tgatcgcccgttgcaaggccgccggggtcaagatttacgccgatgcggtattcaaccagctggctggtggatcaggcgtcggtacaggtggta
gcagctacaatgccggcagcttcagctatcccaatttggctacaacgatttccatcacgctgggagcctcaccaactatgccgaccgcaacaa
tgtgcaaaacggtgccctgctggggctgccggatctggataccggctctgcctatgtgcaggatcagctggctacctatatgaagaccctgagt
ggctggggtgtggcaggttttcgtcttgatgcagcaaagcatatgagcgttgccgatctctcggccatcgtcagcaaggcgggcaatcctttgt
ctactccgaggtgattggtgccacgggtgaaccaatccagccgggcgaatataccggcattggtgccgtgaccgaatttaaatacggcaccga
tctggcctccaacttcaaggggcagatcaagaatctcaagagcatgggcgagagctggggtctgcttgcgtcgaacaaggctgaagtcttgtg
gtcaaccatgaccgtgagcggggacatggcggtggcggtatgctgacctacaaggatggtgccctctacaatctggccaacatcttcatgctg
gcctggccctatggcgcctatccccaggtgatgtccggctatgatttcggcaccaataccgatattggtgggccgagcgctacccttgttcttcc
ggctctagctggaactgcgaacaccgctggagcaacatcgccaacatggtctcgttccacaatgccgcccaaggcacgtccatgaccaactg
gtgggataatggtaataaccagatcgcctttggtcgcggcgccaaggcctttgtggtgatcaacaatgaatcttccactctgagcaagagcctgc
agacgggtctgccagccggggagtactgcaacattctggccggtgatgccctgtgcagcggcagcaccatcaaggtggatgccagcggtat
ggccaccttcaacgtggcagggatgaaggcggcagcgatccatatcaatgccaagcccgatagcaccagcagtggcagctcaggctcttcct
ctggctcttcttcctctgccaccagtaacaagtttgccagcatgaatctgcggggcaccaacaatggctgggccagcaccgccatgacagtgga
tgccaaccgtgtctggtcggcggatgtcaccttttaccggggccgcggatgccaatggtgcccagcgcttcaagtttgatgtctatggcaactgg
acagagagctatggcgatacacaagccgatggcattgccgacaaggggagcgccaaggacatctatttcaatggtgtgggcaagtatcgtgtc
tcgctcaaggagagcgacatgagctacaccctgacccagctctccagcaatcaggcaccggtggcggccatcacccccaagacactctccgt
caagctgggtgactcagtggtgttcgatgcctccggctccaccgatgatgtgggtgtcactggctacagctggtctaccggtggcagtgccaag
accgaaactgtgctgtttgatgctctgggtaccaagaccattaccgtgacagtggccgatgccgatggcttgacctccaaggccagtgccaccg
tcaccgtcaccgatggcagcgtggcttataacagcaactttgccagcctgaacttccgtggcactcccaacagttgggcgcggcagccatga
cgctggtggcagacaacacctgggaggcaacggtcaacttcgatggtcaggccaatcagcgcttcaagttcgatatcaaggtggactggagc
cagaactatggtgatagcaacaaggatggggtggccgaacgtaccggtgccgatattacaccactgtgaccggtcaatataagtgcaattta
acgactccactttgaagtacaccctgaccaagctgtccagatagcagtgccaccagctatagcggaacttgccagcctctaccttgcgtggca
ccccgaacagctgtggtgcaccacctgcatgaagctgttggtcaataacagtggcaggccgaggtgaccttcaccggcaaggtcgatgcca
ctggtgcccaacgcttcaagttcgacgtcaaggtgactggagccagaactacggtgacagcaacatggacgggactgccgaacggactgg
tggcgatatcaccagtgccgtggtgggcacctatctggtgacctttaatgacagcacactgaaatacaccctgaccgccaaataa SEQ ID NO: 204
Met Lys Met Lys Ser Arg Ala Trp Leu Leu Gly Ser Ala Val Ala Met Ala Leu Ala Ser Ser Ala Ala
Asn Ala Gly Val Met Val His Leu Phe Gln Trp Lys Tyr Asn Asp Ile Ala Asn Glu Cys Glu Lys Val
Leu Gly Pro Lys Gly Tyr Glu Ala Val Gln Ile Thr Pro Pro Ala Glu His Leu Gln Gly Ser Ser Trp
Trp Val Val Tyr Gln Pro Val Ser Tyr Lys Asn Phe Thr Ser Leu Gly Gly Asn Glu Ala Glu Leu Lys
Ser Met Ile Ala Arg Cys Lys Ala Ala Gly Val Lys Ile Tyr Ala Asp Ala Val Phe Asn Gln Leu Ala
Gly Gly Ser Gly Val Gly Thr Gly Gly Ser Ser Tyr Asn Ala Gly Ser Phe Ser Tyr Pro Gln Phe Gly
Tyr Asn Asp Phe His His Ala Gly Ser Leu Thr Asn Tyr Ala Asp Arg Asn Asn Val Gln Asn Gly
Ala Leu Leu Gly Leu Pro Asp Leu Asp Thr Gly Ser Ala Tyr Val Gln Asp Gln Leu Ala Thr Tyr Met

FIGURE 16JJJJ

Lys Thr Leu Ser Gly Trp Gly Val Ala Gly Phe Arg Leu Asp Ala Ala Lys His Met Ser Val Ala Asp
Leu Ser Ala Ile Val Ser Lys Ala Gly Asn Pro Phe Val Tyr Ser Glu Val Ile Gly Ala Thr Gly Glu Pro
Ile Gln Pro Gly Glu Tyr Thr Gly Ile Gly Ala Val Thr Glu Phe Lys Tyr Gly Thr Asp Leu Ala Ser
Asn Phe Lys Gly Gln Ile Lys Asn Leu Lys Ser Met Gly Glu Ser Trp Gly Leu Leu Ala Ser Asn Lys
Ala Glu Val Phe Val Val Asn His Asp Arg Glu Arg Gly His Gly Gly Gly Gly Met Leu Thr Tyr Lys
Asp Gly Ala Leu Tyr Asn Leu Ala Asn Ile Phe Met Leu Ala Trp Pro Tyr Gly Ala Tyr Pro Gln Val
Met Ser Gly Tyr Asp Phe Gly Thr Asn Thr Asp Ile Gly Gly Pro Ser Ala Thr Pro Cys Ser Ser Gly
Ser Ser Trp Asn Cys Glu His Arg Trp Ser Asn Ile Ala Asn Met Val Ser Phe His Asn Ala Ala Gln
Gly Thr Ser Met Thr Asn Trp Trp Asp Asn Gly Asn Asn Gln Ile Ala Phe Gly Arg Gly Ala Lys Ala
Phe Val Val Ile Asn Asn Glu Ser Ser Thr Leu Ser Lys Ser Leu Gln Thr Gly Leu Pro Ala Gly Glu
Tyr Cys Asn Ile Leu Ala Gly Asp Ala Leu Cys Ser Gly Ser Thr Ile Lys Val Asp Ala Ser Gly Met
Ala Thr Phe Asn Val Ala Gly Met Lys Ala Ala Ala Ile His Ile Asn Ala Lys Pro Asp Ser Thr Ser
Ser Gly Ser Ser Gly Ser Ser Ser Gly Ser Ser Ser Ser Ala Thr Ser Asn Lys Phe Ala Ser Met Asn Leu
Arg Gly Thr Asn Asn Gly Trp Ala Ser Thr Ala Met Thr Val Asp Ala Asn Arg Val Trp Ser Ala Asp
Val Thr Phe Thr Gly Ala Ala Asp Ala Asn Gly Ala Gln Arg Phe Lys Phe Asp Val Tyr Gly Asn Trp
Thr Glu Ser Tyr Gly Asp Thr Gln Ala Asp Gly Ile Ala Asp Lys Gly Ser Ala Lys Asp Ile Tyr Phe
Asn Gly Val Gly Lys Tyr Arg Val Ser Leu Lys Glu Ser Asp Met Ser Tyr Thr Leu Thr Gln Leu Ser
Ser Asn Gln Ala Pro Val Ala Ala Ile Thr Pro Lys Thr Leu Ser Val Lys Leu Gly Asp Ser Val Val
Phe Asp Ala Ser Gly Ser Thr Asp Asp Val Gly Val Thr Gly Tyr Ser Trp Ser Thr Gly Gly Ser Ala
Lys Thr Glu Thr Val Leu Phe Asp Ala Leu Gly Thr Lys Thr Ile Thr Val Thr Val Ala Asp Ala Asp
Gly Leu Thr Ser Lys Ala Ser Ala Thr Val Thr Val Thr Asp Gly Ser Val Ala Tyr Asn Ser Asn Phe
Ala Ser Leu Asn Phe Arg Gly Thr Pro Asn Ser Trp Gly Ala Ala Ala Met Thr Leu Val Ala Asp Asn
Thr Trp Glu Ala Thr Val Asn Phe Asp Gly Gln Ala Asn Gln Arg Phe Lys Phe Asp Ile Lys Gly Asp
Trp Ser Gln Asn Tyr Gly Asp Ser Asn Lys Asp Gly Val Ala Glu Arg Thr Gly Ala Asp Ile Tyr Thr
Thr Val Thr Gly Gln Tyr Lys Val Gln Phe Asn Asp Ser Thr Leu Lys Tyr Thr Leu Thr Lys Leu Ala
Asp Ser Ser Ala Thr Ser Tyr Ser Ala Asn Phe Ala Ser Leu Tyr Leu Arg Gly Thr Pro Asn Ser Trp
Gly Thr Thr Ala Met Lys Leu Val Ala Asn Asn Ser Trp Gln Ala Glu Val Thr Phe Thr Gly Lys Gly
Asp Ala Thr Gly Ala Gln Arg Phe Lys Phe Asp Val Lys Gly Asp Trp Ser Gln Asn Tyr Gly Asp Ser
Asn Met Asp Gly Thr Ala Glu Arg Thr Gly Gly Asp Ile Thr Ser Ala Val Val Gly Thr Tyr Leu Val
Thr Phe Asn Asp Ser Thr Leu Lys Tyr Thr Leu Thr Ala Lys

SEQ ID NO: 205
atgtaccgcgtaatacctattattttgattatgagtatgattgtagcttgtgagtctccaaagaaaaaaacaaccgaaaccgctcaaccttcaacaaa
tgccgaaaaaccctttgtttgggaggcgtgccaatgtatattttttgttaactgaccgttttaacaacggtaacccaaacaatgacatcaattttaatag
gactaaagaatcaggaaaactccgcaattttatgggaggcgatatcaagggcatcacccaaaaaataaatgaggggtattttagtaaactaggc
gttaatgccatctggcttaccccggttgttgaacaaatacatggcagtgttgatgaaggtaccggcaatacctatgcctttcatggctattgggcca
aagattggaaaaacttagaccctagttggcacaaaagaagadcttgccgaactggtggcaactgccatgcaaaaggcatcaggataottta
gatgtggtaataaacodacggcccgttaacogaccaagaccoggtttggggagaagattgggtacgtacaggccgcagtgtacctatga
taattacaccaataccaccagttgcacgctggtagccaatttacctgatatacttacagaaagtaatgaaaatgtggccttaccaaccttttgttaga
taaatggaaagccgaaggcagattagagcaagaactaaaagaacttgacgattttttttcccgcacaggccacccacgcgcaccccgcttttac
attattaaatggcttaccgattacatccgagaattttgggtagatgggtttagggttgataccgtaaaacataccgaagaaacggtttgggccgag
ttgtatgatgaagccgtaattgcttttgccgaatataaaaaagccaacccagacaaggtattggacgataatgaattatatggtaggcgaagtgt
acaactacggtatttccggcggaaggttctatgatttcggcgataaaaaggtggactattttgaccacggatttaaaagcctcatcaatttgaaatg
aaatatgatgccaattttacctacgatacacttttaggaagtacgataccctttgcataccaaacttaaaggcagaagtgtgctcaactacctctca
tctcacgacgatggaagtccatttgataaaatgcggcaaaaaccatacgagtcggctacaaaattactgctcactccgggcgcatcccaaatttat
tacggtgacgaaaccgccagaagccttaacatagaaggcgcacagggagatgctacgcttcgttcgtttatgaattgggaagagctcgcagaa
gaccctgccaagcaaaaaatacttcagcattggcaaaaactgggcagtttcaggaacaaccaccccgcagttggtgccggaaggcacaaaac
cctiggcaaaaagccgttttacaccttttagcagggttatcaaaaaaatggttttattgacaaagttgtggtagcattagatgcccctaaaggccaaa
aacaaattaccgttaatggtgttttgatgacggtacaaaacttgtagatgcctattcaggcaaagaaacctcagttaaaaatggtatcgtttcacttt
cttctgaatttgatattgtttgttagaacaaaataa

FIGURE 16KKKK

SEQ ID NO: 206

Met Tyr Arg Val Ile Pro Ile Ile Leu Ile Met Ser Met Ile Val Ala Cys Glu Ser Pro Lys Lys Lys Thr
Thr Glu Thr Ala Gln Pro Ser Thr Asn Ala Glu Lys Pro Phe Val Trp Glu Ala Ala Asn Val Tyr Phe
Leu Leu Thr Asp Arg Phe Asn Asn Gly Asn Pro Asn Asn Asp Ile Asn Phe Asn Arg Thr Lys Glu
Ser Gly Lys Leu Arg Asn Phe Met Gly Gly Asp Ile Lys Gly Ile Thr Gln Lys Ile Asn Glu Gly Tyr
Phe Ser Lys Leu Gly Val Asn Ala Ile Trp Leu Thr Pro Val Val Glu Gln Ile His Gly Ser Val Asp
Glu Gly Thr Gly Asn Thr Tyr Ala Phe His Gly Tyr Trp Ala Lys Asp Trp Thr Asn Leu Asp Pro Asn
Phe Gly Thr Lys Glu Asp Leu Ala Glu Leu Val Ala Thr Ala His Ala Lys Gly Ile Arg Ile Leu Leu
Asp Val Val Ile Asn His Thr Gly Pro Val Thr Asp Gln Asp Pro Val Trp Gly Glu Asp Trp Val Arg
Thr Gly Pro Gln Cys Thr Tyr Asp Asn Tyr Thr Asn Thr Thr Ser Cys Thr Leu Val Ala Asn Leu Pro
Asp Ile Leu Thr Glu Ser Asn Glu Asn Val Ala Leu Pro Thr Phe Leu Leu Asp Lys Trp Lys Ala Glu
Gly Arg Leu Glu Gln Glu Leu Lys Glu Leu Asp Asp Phe Phe Ser Arg Thr Gly His Pro Arg Ala Pro
Arg Phe Tyr Ile Ile Lys Trp Leu Thr Asp Tyr Ile Arg Glu Phe Gly Val Asp Gly Phe Arg Val Asp
Thr Val Lys His Thr Glu Glu Thr Val Trp Ala Glu Leu Tyr Asp Glu Ala Val Ile Ala Phe Ala Glu
Tyr Lys Lys Ala Asn Pro Asp Lys Val Leu Asp Asp Asn Glu Phe Tyr Met Val Gly Glu Val Tyr
Asn Tyr Gly Ile Ser Gly Gly Arg Phe Tyr Asp Phe Gly Asp Lys Lys Val Asp Tyr Phe Asp His Gly
Phe Lys Ser Leu Ile Asn Phe Glu Met Lys Tyr Asp Ala Asn Phe Thr Tyr Asp Thr Leu Phe Arg Lys
Tyr Asp Thr Leu Leu His Thr Lys Leu Lys Gly Arg Ser Val Leu ... n Tyr Leu Ser Ser His Asp Asp
Gly Ser Pro Phe Asp Lys Met Arg Gln Lys Pro Tyr Glu Ser Ala ... r Lys Leu Leu Leu Thr Pro Gly
Ala Ser Gln Ile Tyr Tyr Gly Asp Glu Thr Ala Arg Ser Leu Asn Ile Glu Gly Ala Gln Gly Asp Ala
Thr Leu Arg Ser Phe Met Asn Trp Glu Glu Leu Ala Glu Asp Pro Ala Lys Gln Lys Ile Leu Gln His
Trp Gln Lys Leu Gly Ser Phe Arg Asn Asn His Pro Ala Val Gly Ala Gly Arg His Lys Thr Leu Gly
Lys Lys Pro Phe Tyr Thr Phe Ser Arg Val Tyr Gln Lys Asn Gly Phe Ile Asp Lys Val Val Val Ala
Leu Asp Ala Pro Lys Gly Gln Lys Gln Ile Thr Val Asn Gly Val Phe Asp Asp Gly Thr Lys Leu Val
Asp Ala Tyr Ser Gly Lys Glu Thr Ser Val Lys Asn Gly Ile Val Ser Leu Ser Ser Glu Phe Asp Ile
Val Leu Leu Glu Gln Lys.

SEQ ID NO: 207 ctgtcgactgagcctttcgttttgggctcgagactgactctcagcccaccccgcagtagctccagacggagtagccgtaatagccgttggccgg
gtcgtgggcagggggcctcgaggtacacccacccgcttgagtccacccacttgtccacccagccgccgaggttgccggtgtactcgtggatgc
acgctcccgcgaacttcggaacgtagacccaccttccggctttgcttgaggcgaggttgatgtatgttatcagtcccggcttgcttccgtagccgt
ttctcacgaatatcagctcgtcgttgtcgtagtaaacgacgtcagtgcttcctccggccaggttgtcatgtatccagatgaggttcttgagcttatcct
tgttgagccactcctcgtagtcgcggtagaatattgtcggctggccctcgtaggtgaggatgaacgcgtaggctggatacttgttccagattatat
cggtgtcgtggtttgcaacgaaggttacggccttaaacgggtcgcggctgacgactgtgccccgttcttgagggcctcgacgagtgcgggaa
tgttcttgttgtcaaaggccgcgtccatctgtagtagagcgggaagtcgaagacccttggcgccgctcgagtaggcccagttgaggagtgcatc
aacgttcgtgtccagtastcgccaacgctccagctngccccatcagttacgcagtcctrgaagaaccacgctccgtggccctloacgtagtc
aaageccgagncateaacgccgatgctccttagctagcgggcgtagctcatagotcgccoagagecagtgctggtcccagctcttctcgttg
ggctatgtctgggaagcctccaaatgtgccctcgtcacagcacttgacctcgttggggtggaagtcgaggtagttggcagtatatttgcccgagg
ccacctttgagaagtccgtccaggtgtagtccccaaacgaacgggttccactcgaggtctccgcctgcgcggtggtttatgacgatgtccgctatg
acctttatgccgtaggcatgggccgtgtttatcatgttcacgagctcctgcttggagccaaagcgcgtctctaccgttccctctggtcgtactcacc
gaggtcaaagaagtcgtaggggtcgtagcccatcgaataggcgccgcccatgcccttgctcgccgggggaatccaaatggcggatattcccg
cctcgtaccactccggtatcttgctcctgatggtgtcccaccagattcctccacctgggacgtcccagtagaaggcctgcattataacgccgccct
cttccagctcggagtacttggccataagttacctcctactagtagattaaaa

SEQ ID NO: 208

Leu Ser Thr Glu Pro Phe Val Leu Gly Ser Arg Leu Thr Leu Ser Pro Pro Arg Ser Ser Ser Arg Arg
Ser Ser Arg Asn Ser Arg Trp Pro Gly Arg Gly Gln Gly Pro Arg Gly Thr Pro Thr Arg Leu Ser Pro
Pro Thr Cys Pro Pro Ser Arg Arg Gly Cys Arg Cys Thr Arg Gly Cys Thr Leu Pro Arg Thr Ser Glu
Arg Arg Pro Thr Phe Arg Leu Cys Leu Arg Arg Gly Cys Met Leu Ser Val Pro Ala Cys Phe Arg

FIGURE 16LLLL

Ser Arg Phe Ser Arg Ile Ser Ala Arg Arg Cys Arg Ser Lys Arg Arg Gln Cys Phe Leu Arg Pro Gly Cys His Val Ser Arg Gly Ser Ala Tyr Pro Cys Ala Thr Pro Arg Ser Arg Gly Arg Ile Leu Ser Ala Gly Pro Arg Arg Gly Thr Arg Arg Leu Asp Thr Cys Ser Arg Leu Tyr Arg Cys Arg Gly Leu Gln Arg Arg Leu Arg Pro Thr Gly Arg Gly Arg Leu Cys Pro Arg Ser Gly Pro Arg Arg Val Arg Glu Cys Ser Cys Cys Gln Arg Pro Arg Pro Ser Cys Ser Arg Ala Gly Ser Arg Arg Pro Trp Arg Arg Ser Ser Arg Pro Ser Gly Val His Gln Arg Trp Cys Pro Ser Thr Arg Gln Arg Pro Ser Arg Pro Thr Ser Ala Ser Pro Arg Pro Thr Leu Arg Gly Pro Ser Arg Ser Gln Ser Ala Arg His Gln Arg Arg Cys Ser Leu Gly Arg Arg Arg Ser Ser His Arg Ser Pro Arg Ala Ser Ala Gly Pro Ser Ser Ser Arg Gly Leu Cys Leu Gly Ser Leu Gln Met Cys Pro Arg His Ser Thr Pro Arg Trp Gly Gly Ser Arg Gly Ser Trp Gln Tyr Ile Cys Pro Arg Pro Pro Leu Arg Ser Pro Ser Arg Cys Ser Pro Gln Arg Thr Gly Ser Thr Arg Gly Leu Arg Leu Arg Gly Gly Leu Arg Cys Pro Leu Pro Leu Cys Arg Arg His Gly Pro Cys Leu Ser Cys Ser Arg Ala Pro Ala Trp Ser Gln Ser Ala Ser Leu Pro Phe Pro Ser Gly Arg Thr His Arg Gly Gln Arg Ser Arg Arg Gly Arg Ser Pro Ser Asn Arg Arg Arg Pro Cys Pro Cys Ser Pro Gly Glu Ser Lys Trp Arg Ile Phe Pro Pro Arg Thr Thr Pro Val Ser Cys Ser Trp Cys Pro Thr Arg Phe Leu His Leu Gly Arg Pro Ser Arg Arg Pro Ala Leu Arg Arg Pro Leu Pro Ala Arg Ser Thr Trp Pro Val Thr Ser Tyr Ile Lys

SEQ ID NO: 209
atgattcagcccatgcactctcgggaacaggcctgccgtctcattccggcactgatcatgacatttgcactggcactgccgttgcaaattcgtgccg
atgtcaccctgcatgctttcaactggagctatgccgatgtcgctgatcgggccgttgacatcgctgcagcagggtacagtgccgtgctggtggccc
cgccacttcgatccgaaggcacggcctggtgggcgcgataccagccccaggatctccgccttatcgaccatccgctgggcaatacacatgacttc
gtcaacatgatcgatgctctcgatgatgtgggtgtgggcgtgtacgccgacatcgtgctcaaccacatggccaatgaggctgcacaaaggcctga
cctgaactaccctggtcaggcagtgcttgacgaatatgcttccgatcccggtcatttcgagggcttgaggctgttcggtaatctgagcttcaatttcct
gtcgcaacatgatttcggacccgcccagtgcattcaggattacagcgatgtgtttcaggtccagaactggcggctgtgcggaccgccgccggacc
cggggcctgcccgacctggtcgccaatgactgggtgatctctcaacagcgccagtatctggaagccatcaaggcgctgggtgtggctggcatgcg
catcgacgcggtcaagcatatgcccatgagccatatcaatgccgttctcaccccgagatccggtcgggcttgcatgtgtttggcgaagtcatcacc
tccggtggggctggtgatacatcctacgaccgttttctggccccttacctggcacaaagcgaccatggtgcctatgactttccattgtttgaaaccatt
cgccgtgctttcggcttcggtggcagcatgagtgaactggtcgatcctgctgcctacggtcaggccctgccaccggaccgcgccatcaccttcgtc
atcacgcacgatattccgaacaatgacggatttcgctaccagatactcgaccccgtcgatgaatcactggcctacgcctacattctgggccgcgatg
gcggtgtccgcttctgtattccgacaacaatgaaagcggcgatggccgctggatcgatgcctggcaacgtccggatctggttgcaatggtcggct
tccacaatgcagtccacggtcaggacatggccgtgctttcacatgacgactgccacctgctgtttcggcgcggcagcctcgggattgtcggcatca
acaagtgcggccatgcactcagctcctgggtcaacatgaaccagagcgtactgtggtggtacgcggactacacagacgtgctcgacagcaacag
cgttgtcaacatccagtcatcctggcacgagttcatccttcccgcccgccaggcacgcctgtggttgcga SEQ ID NO: 210
MIQPMHSREQACRLIPALIMTFALALPLQIRADVTLHAFNWSYADVADRAVDIAAAGYSA
VLVAPPLRSEGTAWWARYQPQDLRLIDHPLGNTHDFVNMIDALDDVGVGVYADIVLNHM
ANEAAQRPDLNYPGQAVLDEYASDPGHFEGLRLFQNLSFNFLSEHDFGPAQCIQDYSDVF
QVQNWRLCGPPPDPGLPDLVANDWVISQQRQYLEAIKALGVAGMRIDAVKHMPMSHINA
VLTPEIRSGLHVFGEVITSGGAGDTSYDRFLAPYLAQSDHGAYDFPLFETIRRAFGFGGSMS
ELVDPAAYGQALPPDRAITFVITHDIPNNDGFRYQILDPVDESLAYAYILGRDGGVPLLYSD
NNESGDGRWIDAWQRPDLVAMVGFHNAVHGQDMAVLSHDDCHLLFRRGSLGIVGINKC
GHALSSWVNMNQSVLWWYADYTDVLDSNSVVNIQSSWHEFILPARQARLWLR SEQ ID NO: 211
GTGTTTCGTTCTGACACAGTTTCGCGTACCTGCATGTATGGTGCGCTGCGTAATGCCTA
CCAACCCGATCGGGTGTTTACTGGAGTCACGGTGCGGACATGCAACTTAAAAAAGCAT
GCTCATCGCCAGGCGCTGTTGTTCATCGTGACGCGGTGCCTGTGCCTGAAATCCAGGC
AGACCCATAAAAACAACAACAAACCGATAACAAACGACCCAAGCCTTCTAAGAGGAG
AAAACGGGATGGCTTTTAAACTACGCAAAAAGGCGCTCGTTGGCCTGTTCACGGCCGG

FIGURE 16MMMM

CGCAATGGTATATGCCGGTGCAGCGGCGAGTGGTGAAATCATTCTGCAGGGCTTCCAC
TGGCACTCCAAGTGGGGCGGCAACAATCAGGGTTGGTGGCAGGTGATGGAAGGTCAG
GCCAACACCATCGCCAACGCCGGCTTTACGCACGTGTGGTTCCCGCCGGTCCATAACT
CGGCCGATGCCGAGGGTTACCTACCCCGCGAGCTGAACAACCTCAACTCCAGCTATGG
CTCCGAAGCACAGCTGCGCAGCGCCATCCAGGCACTGAACAATCGCGGCGTGCATGCG
ATTGCCGATGTGGTCATGAACCACCGGGTGGGCTGCTCTGGCTGGGCGGATTTCTGTA
ACCCGGACTGGCCGACCTGGTACATCGTCGCCAATGATTCCTGGCCCGGTGGCCCGAA
AAGCCAGAACTGGGACACGGGTGAGACGTACCACGCCGCCCGTGACCTCGATCACGC
CAATCCGCAGGTGCGCAACGATATCTCGCACTACCTGAACAGCCGCCTCAAGGACGTC
GGCTTCTCCGGCTGGCGCTGGGACTATGCCAAGGGTTTCTGGCCCGGCTATGTCGGCG
AGTACAACTGGAACACCAACCCGAACTTCTGTGTGGGTGAGGTGTGGGACGATCTCGA
CCCCAACAATCCCAACCCGCACCGCCAGCAACTGGTGGACTGGGTTGATGCTACCGGT
GGCAGTTGTCACGTCTTCGACTTCACCACCAAGGGGCTGACGAACTATGCGCTGCAGC
ATGGCCAGTACTGGCGCCTGCAGGGTGATAATGGTGGCCCGGCTGGCGGCATCGGCTG
GTGGCCGCAACGCATGGTGACCTTCGTCGACAACCATGACACGGGCCCGAGCAATCAC
TGTGGTGACGGCCAGAACCTCTGGCCCGTGCCCTGTGACAAGGTCATGGAGGCGTATG
CCTACATCCTGACCCATCCGGGCGTGCCGTCGGTGTACTGGACGCACTTCTTCAACTGG
AATCTTGGTAGCGAGATCAGCCAGTTGATGCAGATCCGCAAGAACCAGGGCGTGCACT
CCGGTTCCGACGTCTGGATCGCCGAGGCCCGTCACGGCCTGTACGCCGCCTATATCAA
CGGTAATGTGGCGATGAAGATGGGCTGGGATAACTGGAGCCCGGGCTGGGGCTGGTC
GCTGGCGGCCTCCGGTAACAACTGGGCCGTCTGGACACGCTGA

SEQ ID NO: 212
VFRSDTVSRTCMYGALRNAYQPDRVFTGVTVRTCNLKKHAHRQALLFIVTRCLCLKSRQT
HKNNNKPITNDPSLLRGENGMAFKLRKKALVGLFTAGAMVYAGAAASGEIILQGFHWHS
KWGGNNQGWWQVMEGQANTIANAGFTHVWFPPVHNSADAEGYLPRELNNLNSSYGSEA
QLRSAIQALNNRGVHAIADVVMNHRVGCSGWADFCNPDWPTWYIVANDSWPGGPKSQN
WDTGETYHAARDLDHANPQVRNDISHYLNSRLKDVGFSGWRWDYAKGFWPGYVGEYN
WNTNPNFCVGEVWDDLDPNNPNPHRQQLVDWVDATGGSCHVFDFTTKGLTNYALQHGQ
YWRLQGDNGGPAGGIGWWPQRMVTFVDNHDTGPSNHCGDGQNLWPVPCDKVMEAYA
YILTHPGVPSVYWTHFFNWNLGSEISQLMQIRKNQGVHSGSDVWIAEARHGLYAAYINGN
VAMKMGWDNWSPGWGWSLAASGNNWAVWTR

| | SEQ ID NO.: 81 | Pyro | Pyro | thermo | therm2 | SEQ ID NO.: 75 | SEQ ID NO.: 77 | SEQ ID NO.: 83 | SEQ ID NO.: 85 | SEQ ID NO.: 79 | SEQ 437 |
|---|---|---|---|---|---|---|---|---|---|---|---|
| SEQ ID | 100 | 91.7 | 75.1 | 82.1 | 80.1 | 82.5 | 82.6 | 82.1 | 82.6 | 83 | 77.8 |
| pyro | | 100 | 74.8 | 82.5 | 80.5 | 82 | 82.2 | 82.9 | 82.8 | 84 | 78.5 |
| Pyro2 | | | 100 | 71.5 | 71.1 | 74 | 74.2 | 77 | 77.1 | 73 | 70.5 |
| therm | | | | 100 | 81.7 | 83.5 | 83.8 | 82.8 | 83.2 | 83.8 | 76.4 |
| therm2 | | | | | 100 | 88.9 | 88.8 | 84.1 | 84.7 | 84 | 76.3 |
| SEQ ID NO.: 75 | | | | | | 100 | 98.3 | 84.6 | 85.2 | 85.5 | 77 |
| SEQ ID | | | | | | | 100 | 84.8 | 84.9 | 85.4 | 77.4 |
| SEQ ID | | | | | | | | 100 | 96 | 83.3 | 78.5 |
| SEQ ID | | | | | | | | | 100 | 83 | 78.1 |
| SEQ ID | | | | | | | | | | 100 | 79.8 |
| Clone A | | | | | | | | | | | 100 |

FIGURE 18

| Operating Conditions | D45 | Termamyl® SC Amylase |
|---|---|---|
| Temperature | 95°C | 85°C |
| pH range | 4.4 – 5.6 | 5.0 – 6.0<br>pH optimum 5.7 |
| Ca++ | No significant impact on viscosity reduction | Not required |
| Recycled Backset | Up to 30% well tolerated | Up to 30% well tolerated |
| Enzyme Dose | 0.4 – 0.6 kg/MT starch | 0.3 – 0.5 kg/MT starch |
| DE after liquefaction | 6-10 | 12-14 |

FIGURE 29

```
           *         *        30         *         *        60
tccaaagaattgaacgtcgtcggatgatcgtgatggtcagttttgaggtatcttccgaag

*         *        90         *         *       120
agccaattggattacccggcagtccggcagtccgacggtccagacaaggatcaatcagg

*         *       150         *         *       180
gcctggcactatttagcatgtcggttagtccccaatcggctctgcatttgacagcggac

*         *       210         *         *       240
atctgccgatcaggaacgaaacggtgcctgccgttgttgcctgtgagctctttatgcat

*         *       270         *         *       300
gtcaattcataataatcccgataataggccgcagctattccaccctggggaaagggtttg

*         *       330         *         *       360
ttgaatgtcggcgatttggggtacatctgggggttcggcacttcagtgtctccaggtccg

*         *       390         *         *       420
aatttcatgcattcatgcatgaaaatgcggagggaacctcggcactgtcaccatcccccgt

*         *       450         *         *       480
caaactacggcttttggcgggctacattggctacaatggccacaatggctacaacggcct

*         *       510         *         *       540
gtcaaggtatccattaatttctccgaagctcctgcaacgtttcgacaccctaaatttccg

*         *       570         *         *       600
tttccgctacggagagcggagtaccggatacttttggacttttcatgtgcttctgtcgg

*         *       630         *         *       660
gcattcaaagaccgggcctgtcctaacgtccaggggatcgtttggcagatcttccctcat

```
gcgttcacagagcgaagtttgtttaattgagtcatcaaaacATGTTATTCCAACCGACTT
                                          M  L  F  Q  P  T
         *         *       750          *         *       780
TGTGCGCGGCCCTTGGACTCGCCGCCTTGATCGTCCAAGGCGGAGAAGCCAGACCTGAAA
 L  C  A  A  L  G  L  A  A  L  I  V  Q  G  G  E  A  R  P  E
         *         *       810          *         *       840
CAACCGTCCCACATGCAACGGGCTCGCTCGACGACTTCCTCGCCGCACAGAGTCCGATTG
 T  T  V  P  H  A  T  G  S  L  D  D  F  L  A  A  Q  S  P  I
         *         *       870          *         *       900
CTTTCCAAGGCATCCTGAACAATATCGGGCCTAGCGGAGCGTACTCGGAAGGTGTCAATC
 A  F  Q  G  I  L  N  N  I  G  P  S  G  A  Y  S  E  G  V  N
         *         *       930          *         *       960
CGGGTGTGGTCATTGCGAGTCCAAGTAAACAAGATCCCGACTgtatgcctgctctggaaa
 P  G  V  V  I  A  S  P  S  K  Q  D  P  D
         *         *       990          *         *      1020
tttttcaattctgttggcaggactctctctctaatatggcacatagACTTTTACACCTGG
                                               Y  F  T  W
         *         *      1050          *         *      1080
GTGCGCGACGCTGCTCTCACTGTCCAATATCTGGTGGAGGAGCTGGTTGCAGGAAATGCC
 V  R  D  A  A  L  T  V  Q  Y  L  V  E  E  L  V  A  G  N  A
         *         *      1110          *         *      1140
AGTCTTCAGTTCCTCATTCAGGACTACATCAGCTCCCAGGCACGACTGCAGACGGTGGAA
 S  L  Q  F  L  I  Q  D  Y  I  S  S  Q  A  R  L  Q  T  V  E
         *         *      1170          *         *      1200
AATCCATCCGGCTCCCTCTCGTCGGGTGGTCTAGGAGAGCCCAAGTTTCATGTCGACGAG
 N  P  S  G  S  L  S  S  G  G  L  G  E  P  K  F  H  V  D  E
         *         *      1230          *         *      1260
ACCGCCTTTACGGACTCCTGGGGCCGACCACAGCGGGACGGCCCGCCTCTCCGCGCCATT
 T  A  F  T  D  S  W  G  R  P  Q  R  D  G  P  P  L  R  A  I
         *         *      1290          *         *      1320
GCCATGATTTCGTTTGCCAATTACCTGATTgtaagtcagatttcccatcatgcgagtaaa
 A  M  I  S  F  A  N  Y  L  I
         *         *      1350          *         *      1380
ttgacatggatgtgctcagtgtagttttcagGACAACGGTCATCAATCGACTGTGGAGGA
                               D  N  G  H  Q  S  T  V  E  D
         *         *      1410          *         *      1440
CATCATCTGGCCGATTGTTCGCAATGACTTGTCCTATGTCTCGCAGCATTGGAACGAAAC
 I  I  W  P  I  V  R  N  D  L  S  Y  V  S  Q  H  W  N  E  T
         *         *      1470          *         *      1500
AACTTTTggtatgtgcttacgccgtactagttgattggagagtttggattataggagagc
 T  F
         *         *      1530          *         *      1560
ctcaagctaatacggagttttttccgaaGACATCTGGGAGGAAGTCCATAGCTCATCGTTT
                            D  I  W  E  E  V  H  S  S  S  F
         *         *      1590          *         *      1620
TTCACCACGGCTGTCCAGTACCGTGCTCTGGTCCAAGGCAGTGCCTTGGCTAGCAAGCTC
 F  T  T  A  V  Q  Y  R  A  L  V  Q  G  S  A  L  A  S  K  L
         *         *      1650          *         *      1680
GGCCATACCTGCGACAACTGCGGGTCCCAAGCACCGCAGATCCTTTGCTTCCTGCAGTCG
 G  H  T  C  D  N  C  G  S  Q  A  P  Q  I  L  C  F  L  Q  S
         *         *      1710          *         *      1740
TATTGGACCGGGTCGCACATCTTAGCCAACACCGGTGGCGGCCGCTCGGGAAAGGACGTC
```

FIGURE 34B

```
   Y   W   T   G   S   H   I   L   A   N   T   G   G   G   R   S   G   K   D   V
                           *               1770          *               *              1800
AGCACGATCCTCGGCGTCATTGGCTCGTTTGATCCAACGCCGACTGTGATGACGTTACC
   S   T   I   L   G   V   I   G   S   F   D   P   N   A   D   C   D   D   V   T
           *               *              1830          *               *              1860
TTCCAGCCCTGCTCGGCCCGGGCTCTTGCAAATCACAAGCAGGTCGTTGACAGCTTCCGC
   F   Q   P   C   S   A   R   A   L   A   N   H   K   Q   V   V   D   S   F   R
           *               *              1890          *               *              1920
AGTATCTATGCCATCAACGCTGGCATCCCGTCAGGGTCGGCTGTTGCGGTTGGACGTTAT
   S   I   Y   A   I   N   A   G   I   P   S   G   S   A   V   A   V   G   R   Y
           *               *              1950          *               *              1980
CCCGAGGATGTCTATCAGGGTGGACACCCCTGGTACCTAACAACGGCTGCGGCGGCGGAG
   P   E   D   V   Y   Q   G   G   H   P   W   Y   L   T   T   A   A   A   A   E
           *               *              2010          *               *              2040
CAGCTTTACGACGCCATTTACCAGTGGAACCATGTAGGGCACATCGACATCAATGCTGTC
   Q   L   Y   D   A   I   Y   Q   W   N   H   V   G   H   I   D   I   N   A   V
           *               *              2070          *               *              2100
AATCTGGACTTCTTCAAGAGCATTTATCCGTCAGCCGCCGAGGGCACATACACATCAGAC
   N   L   D   F   F   K   S   I   Y   P   S   A   A   E   G   T   Y   T   S   D
           *               *              2130          *               *              2160
TCTTCAACATTTCAAGACATTATATCTGCTGTACGGACCTATGCGGACGGGTTTCTCAGC
   S   S   T   F   Q   D   I   I   S   A   V   R   T   Y   A   D   G   F   L   S
           *               *              2190          *               *              2220
GTAATTgtaagtccaaaccttcgaaaacgaatgcctcaagtcttccactgacattttgcg
   V   I
                                           *               *              2280
                                         2250
cagGAGAAATACACTCCGCCGGATAACTTGCTTGCCGAGCAGTTCCACCGGGAGACGGGC
       E   K   Y   T   P   P   D   N   L   L   A   E   Q   F   H   R   E   T   G
           *               *              2310          *               *              2340
ATTCCACTATCGGCAGCTTCTCTGACATGGTCCTACGCCGCGCTCAACACGGCCGCGCAG
   I   P   L   S   A   A   S   L   T   W   S   Y   A   A   L   N   T   A   A   Q
           *               *              2370          *               *              2400
CGGCGAGCGTCAATCGTGCCCTCACCGTGGAACTCTAACAGCACAGATCTCCCGGACAAA
   R   R   A   S   I   V   P   S   P   W   N   S   N   S   T   D   L   P   D   K
           *               *              2430          *               *              2460
TGCTCGGCAACCTCGGCAACAGGGCCGTATGCCACGCCCACAAACACGGCATGGCCAACC
   C   S   A   T   S   A   T   G   P   Y   A   T   P   T   N   T   A   W   P   T
           *               *              2490          *               *              2520
ACTACGCAGCCACCGGAGCGGCCGGCATGCACACCGCCGTCGGAAGTAACACTCACCTTC
   T   T   Q   P   P   E   R   P   A   C   T   P   P   S   E   V   T   L   T   F
           *               *              2550          *               *              2580
AACGCGCTCGTCGACACCGCGTTTGGCCAGAATATTTATCTCGTGGGCTCCATTCCGGAG
   N   A   L   V   D   T   A   F   G   Q   N   I   Y   L   V   G   S   I   P   E
           *               *              2610          *               *              2640
CTCGGATCGTGGGATCCGGCCAACGCCCTCTTGATGAGCGCAAAGAGCTGGACTAGCGGA
   L   G   S   W   D   P   A   N   A   L   L   M   S   A   K   S   W   T   S   G
           *               *              2670          *               *              2700
AATCCGGTCTGGACGCTATCCATTTCCCTTCCAGCAGGAACCTCTTTTGAGTACAAGTTC
   N   P   V   W   T   L   S   I   S   L   P   A   G   T   S   F   E   Y   K   F
           *               *              2730          *               *              2760
ATTCGAAAGGATGATGGTTCCTCGGATGTTGTCTGGGAAAGTGACCCGAATCGTTCGTAC
   I   R   K   D   D   G   S   S   D   V   V   W   E   S   D   P   N   R   S   Y
```

FIGURE 34C

```
              *         *       2790         *         *       2820
AACGTGCCGAAGGATTGCGGTGCCAACACGGCCACCGTGAATTCTTGGTGGCGATGAacc
 N   V  P   K   D   C   G   A   N   T   A   T   V   N   S   W   W   R   *
              *         *       2850         *         *       2880
aacttgtttctgtccacactccgccctgttgtcagttcctggtcgtagatcgataaaata

*         *       2910         *         *       2940
tgacttgtgtacttgacaaagaaatgatgtaaaagcgttctgttatgtagtaggttagca

*         *       2970         *         *       3000
cttttccctagtagggagtactccgtaggtatgccgataccgaactccgaccggagtaaa

*         *       3030         *         *       3060
actaacgtgtcgagtatcgcgatgttgcgcgtggggagtaaggacgattagggctgaatg

*         *       3090         *         *       3120
ctgcagatcctttccttcaccgtctcagagacacggagtcaggtttgaccatggccgcgg

*         *       3150         *         *       3180
tgtgaagctgttgatgctcattttcctgtccaatatttcaaggacaacgttgccaacatc

*         *       3210         *         *       3240
aatcccagcaatgagtcctcgtgttgactgtgctgccctgggatcagagacttcgggaat

*         *       3270         *         *       3300
acattgaagttagcaaaacaatgccgtccactaactatgtgcgctcacgtctaccaagtg

*         *       3330         *         *       3360
cacgatccgttctgtggaagggggaagttatcctggtacaggcttgcttgcgattctggat

*         *       3390         *         *       3420
cgactgcgaaaaaaagaggggacatgcgtctggaaagttgcgattcaaaacgatgtcatc

*         *       3450         *         *       3480
agctcattgcctcttgaaatcctgctcgagatcagagattatcttgaactaaacgatatt

*         *       3510         *         *       3540
ctccgaagccggatggtgcgtatcgtcttgttgctcgatgttgaaagagacatttttatt

*         *       3570         *         *       3600
tgacaggagcaaacgtccgaacaagtctcgaaacaatagcgctctattttctcaagcggt

*         *       3630         *         *       3660
ccagtcatgagaccttttctgcgggaggctcttgcgctcctggacatgaaaggcacggag

*         *       3690         *         *       3720
atatccgccacggacgttatggcttatttcgatggtacggtggattgaaatatggaaag

*         *       3750         *         *       3780
ccagtaaagaaaatgtttctcccatggccagaaggccggataagattggagcaaaggatt

```
gagatttattcgcggcggctatattatcatgaatggaagaagagagcagtcggaatgttg

*         *      3870        *         *      3900
gatctggaaactagaaagaggcggctttggcccgcaaacgataacacgtactttgaattc

*         *      3930        *         *      3960
tttgcatctgatcgatatcttttgatctcggggtaagttgaggacaggatagtagattcc

*         *      3990        *         *      4020
tgttggctcgacaggtcgtctaactgcagtgctaggaaacgtctgattgcgtgggatata

*         *      4050        *         *      4080
caggagtcgcggaaagttggggagattagtggtgagccctggcaggtgaacatcgtgcag

*         *      4110
gataaggtcgtcatgtttgaacgaaagtcaa      (SEQ ID NO: 1)
```

| | | | | | | | | |
|---|---|---|---|---|---|---|---|---|
| 69, 70 | gi|12635602|gb|AAK00598.1| | | alpha-amylase [Bacillus megaterium] | Bacillus megaterium | NO HITS | 91 | 80 | 513 | 633 |
| 87, 88 | gi|3984289|gb|AAC87717.1|AR008691 | 0 | Sequence 8 from patent US 5753460 | Unknown, Unclassified | NO HITS | 87 | N/A | 472 | 849 |
| 89, 90 | gi|12006232|gb|AAG44799.1|AF272660.2 | 0 | amylopullulanase (Geobacillus stearothermophilus) | Geobacillus stearothermophilus Bacteria | NO HITS | 75 | 70 | 1100 | 2018 |
| 91, 92 | gi|28423261|gb|AAB89961.1| | | alpha amylase [Geobacillus stearothermophilus] | Geobacillus stearothermophilus Bacteria | NO HITS | 99 | 88 | 549 | 549 |
| 93, 94 | gi|12006232|gb|AAG44799.1|AF272660.2 | 0 | amylopullulanase (Geobacillus stearothermophilus) | Geobacillus stearothermophilus Bacteria | NO HITS | 74 | 70 | 515 | 2018 |
| 95, 96 | gi|15644583|ref|NP_229636.1| | e-145 | alpha-amylase [Thermotoga maritima] | Thermotoga maritima Bacteria | NO HITS | 52 | 58 | 507 | 556 |
| 97, 98 | gi|15644583|ref|NP_229636.1| | e-145 | alpha-amylase [Thermotoga maritima] | Thermotoga maritima Bacteria | NO HITS | 29 | 33 | 976 | 656 |
| 99, 100 | gi|15644583|ref|NP_229636.1| | e-144 | alpha-amylase [Thermotoga maritima] | Thermotoga maritima Bacteria | NO HITS | 53 | 58 | 611 | 656 |
| 101, 102 | gi|13274568|gb|AAK17994.1|AF333075_1 | 0 | [Pseudomonas sp. KFCC10818] | KFCC10818 Bacteria | NO HITS | 61 | 56 | 711 | 765 |
| 103, 104 | gi|28423261|gb|AAB89961.1| | 0 | alpha amylase (Geobacillus stearothermophilus) | Geobacillus stearothermophilus Bacteria | NO HITS | 99 | 99 | 549 | 549 |
| 105, 106 | gi|7222791|gb|AAA63900.1| | 0 | alpha-amylase (Bacillus sp. TS-23) | Bacillus sp. TS-23 Bacteria | NO HITS | 84 | 76 | 550 | 613 |
| 107, 108 | gi|10911118|prf||2020344A | 3E-84 | alpha amylase | Thermoactinomyces vulgaris Bacteria | NO HITS | 37 | N/A | 502 | 463 |
| 109, 110 | gi|4049918|gb|AAC97871.1| | 0 | [Thermococcus hydrothermalis] | Thermococcus hydrothermalis Archaea | NO HITS | 80 | 63 | 457 | 457 |
| 111, 112 | gi|22551108|dbj|BAA21130.1| | 0 | alpha-amylase [Pyrococcus sp.] | Pyrococcus sp. Archaea | NO HITS | 83 | 77 | 471 | 481 |
| 113, 114 | gi|1138131|sp|P06278|AMY_BACLI | 0 | PRECURSOR (1,4-ALPHA-D-GLUCAN | licheniformis Bacteria | NO HITS | 99 | 99 | 512 | 512 |
| 115, 116 | gi|22551108|dbj|BAA21130.1| | | alpha-amylase [Pyrococcus sp.] | Pyrococcus sp. Archaea | NO HITS | 83 | N/A | 445 | 481 |
| 117, 118 | gi|1138310|sp|P22963|AMY1_AERHY | 0 | PRECURSOR (1,4-ALPHA-D-GLUCAN GLUCANOHYDROLASE) | Aeromonas hydrophila Bacteria | NO HITS | 84 | 81 | 491 | 464 |
| 119, 120 | gi|7222791|gb|AAA63900.1| | 0 | alpha-amylase (Bacillus sp. TS-23) | Bacillus sp. TS-23 Bacteria | NO HITS | 93 | 90 | 564 | 613 |
| 121, 122 | gi|2253595|gb|AAC47921.1| | e-101 | alpha-amylase [Drosophila ananassae] | Drosophila ananassae Eukaryota | NO HITS | 42 | 53 | 517 | 494 |
| 123, 124 | gi|1138228|sp|P22998|AMY_STRVL | e-152 | ALPHA-AMYLASE PRECURSOR (1,4-ALPHA-D-GLUCAN | Streptomyces violaceus Bacteria | NO HITS | 46 | 59 | 698 | 639 |
| 125, 126 | gi|22551108|dbj|BAA21130.1| | 0 | alpha-amylase [Pyrococcus sp.] | Pyrococcus sp. Archaea | NO HITS | 84 | 78 | 464 | 481 |
| 127, 128 | gi|7222791|gb|AAA63900.1| | 0 | alpha-amylase (Bacillus sp. TS-23) | Bacillus sp. TS-23 Bacteria | NO HITS | 84 | 84 | 615 | 613 |

FIGURE 35B

| | | | | | | | | |
|---|---|---|---|---|---|---|---|---|
| 129, 130 | gi|7271927|gb|AAF449 83.1|AF240464_1 | 5E-88 | alpha-amylase [Pyrococcus woesei] | Pyrococcus woesei Archaea | NO HITS | 29 | 36 | 817 | 460 |
| 131, 132 | gi|3357892|bc|BAA0160 0.1| | 0-171 | maltopentaose forming amylase [Pseudomonas sp.] | Pseudomonas sp., Bacteria | NO HITS | 61 | 76 | 826 | 814 |
| 133, 134 | gi|7222279|gb|AAG390 0.1| | 0 | alpha-amylase [Bacillus sp. TS-23] | Bacillus sp. TS-23, Bacteria | NO HITS | 97 | 94 | 546 | 613 |
| 135, 136 | gi|7222279|gb|AAG390 0.1| | 0 | alpha-amylase [Bacillus sp. TS-23] | Bacillus sp. TS-23, Bacteria | NO HITS | 84 | 84 | 844 | 613 |
| 137, 138 | gi|2207462|gb|AAA4227 2.1| | 0.46 | tropoelastin [Rattus norvegicus] | Rattus norvegicus Eukaryota | NO HITS | 19 | 11 | 439 | 307 |
| 139, 140 | gi|11226329|emb|CAC2 8455.1| | 0-173 | beta-agarase [Geobacillus stearothermophilus] | Geobacillus stearothermophilus Bacteria | NO HITS | 60 | 59 | 507 | 515 |
| 141, 142 | gi|15601018|ref|NP_23 2548.1| | 0 | alpha-amylase [Vibrio cholerae] | Vibrio cholerae Bacteria | NO HITS | 70 | 67 | 468 | 468 |
| 143, 144 | gi|15601018|ref|NP_23 2548.1| | 0 | alpha-amylase [Vibrio cholerae] | Vibrio cholerae Bacteria | NO HITS | 69 | 85 | 473 | 466 |
| 145, 146 | gi|12855802|gb|AAK00 598.1| | 0 | alpha-amylase [Bacillus megaterium] | Bacillus megaterium Bacteria | NO HITS | 91 | 90 | 613 | 633 |
| 147, 148 | gi|9081818|gb|AAF8628 11.1| | 1E-77 | beta-agarase [Pseudomonas sp. W7] | Pseudomonas sp. W7 Bacteria | NO HITS | 28 | 39 | 781 | 842 |
| 149, 150 | gi|9081818|gb|AAF8626 11.1| | 3E-72 | beta-agarase [Pseudomonas sp. W7] | Pseudomonas sp. W7 Bacteria | NO HITS | 24 | 36 | 634 | 842 |
| 151, 152 | gi|14597798|emb|CAC4 3721.1| | 4E-32 | c_pp0100100937f [Physcomitrella patens] | Physcomitrella patens Eukaryota | NO HITS | 16 | 28 | 704 | 430 |
| 153, 154 | gi|113814|sp|P20845|A MY_BACME | 0 | ALPHA-AMYLASE PRECURSOR (1,4-ALPHA-D-GLUCAN GLUCANOHYDROLASE) | Bacillus megaterium Bacteria | NO HITS | 76 | 73 | 639 | 620 |
| 155, 156 | gi|8502575|gb|AAF7435 69.1| | 0 | alpha-amylase [Bacillus subtilis] | Bacillus subtilis Bacteria | NO HITS | 87 | 96 | 591 | 859 |
| 157, 158 | gi|113814|sp|P20845|A MY_BACME | 0 | ALPHA-AMYLASE PRECURSOR (1,4-ALPHA-D-GLUCAN GLUCANOHYDROLASE) | Bacillus megaterium Bacteria | NO HITS | 85 | 91 | 635 | 520 |
| 159, 160 | gi|113814|sp|P20845|A MY_BACME | 0 | ALPHA-AMYLASE PRECURSOR (1,4-ALPHA-D-GLUCAN GLUCANOHYDROLASE) | Bacillus megaterium Bacteria | NO HITS | 96 | 93 | 628 | 620 |
| 161, 162 | gi|113814|sp|P20845|A MY_BACME | 0 | ALPHA-AMYLASE PRECURSOR (1,4-ALPHA-D-GLUCAN GLUCANOHYDROLASE) | Bacillus megaterium Bacteria | NO HITS | 95 | 96 | 640 | 520 |
| 163, 164 | gi|12855802|gb|AAK00 598.1| | 0 | alpha-amylase [Bacillus megaterium] | Bacillus megaterium Bacteria | NO HITS | 69 | 64 | 473 | 533 |
| 165, 166 | gi|12855802|gb|AAK00 598.1| | 0 | alpha-amylase [Bacillus megaterium] | Bacillus megaterium Bacteria | NO HITS | 89 | 88 | 478 | 533 |
| 167, 168 | gi|113814|sp|P20845|A MY_BACME | 0 | PRECURSOR (1,4-ALPHA-D-GLUCAN GLUCANOHYDROLASE) | Bacillus megaterium Bacteria | NO HITS | 96 | 82 | 631 | 620 |
| 169, 170 | gi|11226329|emb|CAC1 8455.1| | 6-186 | unnamed protein product [Geobacillus stearothermophilus] | Geobacillus stearothermophilus Bacteria | NO HITS | 60 | 69 | 606 | 615 |
| 171, 172 | gi|113814|sp|P20845|A MY_BACME | 0 | ALPHA-AMYLASE PRECURSOR (1,4-ALPHA-D-GLUCAN GLUCANOHYDROLASE) | Bacillus megaterium Bacteria | NO HITS | 98 | 94 | 476 | 520 |
| 173, 174 | gi|113814|sp|P20845|A MY_BACME | 0 | ALPHA-AMYLASE PRECURSOR (1,4-ALPHA-D-GLUCAN GLUCANOHYDROLASE) | Bacillus megaterium Bacteria | NO HITS | 86 | 93 | 531 | 520 |

| | | | | | | | | |
|---|---|---|---|---|---|---|---|---|
| 207, 208 | gi\|15218810\|ref\|NP_17 4202.1\| | 0.94 | plastid ribosomal protein L34 precursor, putative [Arabidopsis thaliana]; | Arabidopsis thaliana Eukaryota | NO HITS | 11 | 10 | 439 | 157 |
| 209, 210 | gi\|477015\|pir\|A47674.a\| | e-178 | alpha-amylase [Xanthomonas campestris] | Xanthomonas campestris | NO HITS | 61 | 68 | 472 | 475 |
| 211, 212 | gi\|15222859\|ref\|NP_177 | 2.10E-69 | alpha-amylase, putative [Arabidopsis thaliana] | Arabidopsis thaliana Eukaryota | NO HITS | 42 | 38 | 495 | 413 |

FIGURE 35E

| | | | | | | | |
|---|---|---|---|---|---|---|---|
| 322, 323 | alpha-amylase precursor [Thermococcus sp. GU5L5] | Thermococcus sp. GU5L5 | 3.2.1.1 | 21326995 | 0 | 1392 | 463 | 461 | 83 |
| 324, 325 | hypothetical protein [Burkholderia fungorum] | Burkholderia fungorum | 3.2.1.1 | 22986674 | 1E-28 | 7379424 | 1296 | 431 | 1146 | 25 |
| 326, 327 | alpha-amylase (EC 3.2.1.1) precursor - Bacillus megaterium | Bacillus megaterium | 3.2.1.1 | 80110 | 7E-98 | 11344494 | 1359 | 452 | 520 | 42 |
| 328, 329 | hypothetical protein [Chloroflexus aurantiacus] | Chloroflexus aurantiacus | 3.2.1.1 | 229970588 | 1E-155 | 535791 | 1677 | 558 | 575 | 53 |
| 330, 331 | hypothetical protein [Chloroflexus aurantiacus] | Chloroflexus aurantiacus | 2.4.1.- | 229971468 | 0 | 4633806 | 3129 | 1042 | 851 | 55 |
| 332, 333 | hypothetical protein [Microbulbifer degradans 2-40] | Microbulbifer degradans 2-40 | 3.2.1.1 | 230027235 | 1E-117 | 166984 | 1707 | 569 | 643 | 49 |
| 334, 335 | hypothetical protein [Microbulbifer degradans 2-40] | Microbulbifer degradans 2-40 | 3.2.1.1 | 230027235 | 7E-91 | 62191 | 2061 | 686 | 643 | 43 |

FIGURE 35F

| | | | | | | | |
|---|---|---|---|---|---|---|---|
| 336, 337 | alpha-amylase (EC 3.2.1.1) precursor - Streptomyces violaceus | Streptomyces violaceus | 3.2.1.1 | 80864 | 0 | 153156 | 1731 | 576 | 569 | 65 |
| 338, 339 | unnamed protein product | Bacillus sp. | 3.2.1.1 | 13539158 | 0 | 14774986 | 1704 | 568 | 587 | 90 |
| 340, 341 | outer membrane protein [Bacteroides thetaiotaomicron] | Bacteroides thetaiotaomicron | 3.2.1.10 | 1478030 | 1E-137 | | 1848 | 615 | 692 | 46 |
| 342, 343 | hypothetical protein [Microbulbifer degradans 2-40] | Microbulbifer degradans 2-40 | 3.2.1.1 | 23027631 | 0 | 13274585 | 2061 | 686 | 563 | 64 |
| 344, 345 | hypothetical protein [Microbulbifer degradans 2-40] | Microbulbifer degradans 2-40 | 3.2.1.1 | 23027631 | 1E-179 | 8247214 | 1980 | 659 | 563 | 62 |
| 346, 347 | amylase precursor | Aeromonas hydrophila | 3.2.1.1 | 141870 | 0 | 141869 | 1398 | 465 | 464 | 92 |
| 348, 349 | alpha-amylase [Nostoc sp. PCC 7120] | Nostoc sp. PCC 7120 | 3.2.1.1 | 17229682 | 0 | 450848 | 1488 | 495 | 492 | 61 |
| 350, 351 | ALPHA-AMYLASE PRECURSOR (1,4-ALPHA-D-GLUCAN GLUCANOHYDROLASE) | Pseudoalteromonas haloplanktis | 3.2.1.1 | 6226551 | 0 | 2467084 | 2001 | 666 | 669 | 67 |
| 352, 353 | hypothetical protein [Microbulbifer degradans 2-40] | Microbulbifer degradans 2-40 | 3.2.1.1 | 23027235 | 1E-135 | 3549647 | 1263 | 420 | 643 | 55 |

FIGURE 35G

| | | | | | | | | |
|---|---|---|---|---|---|---|---|---|
| 354, 355 | ALPHA-AMYLASE PRECURSOR (1,4-ALPHA-D-GLUCAN GLUCANOHYDROLASE) | Aeromonas hydrophila | 3.2.1.1 | 728848 | 0 | 304014 | 2577 | 858 | 443 | 44 |
| 356, 357 | hypothetical protein [Microbulbifer degradans 2-40] | Microbulbifer degradans 2-40 | 3.2.1.1 | 23027235 | 7E-95 | 5442101 | 4875 | 1625 | 643 | 47 |
| 358, 359 | Glycosidase [Vibrio vulnificus CMCP6] | Vibrio vulnificus | 3.2.1.1 | 27366839 | 1E-147 | 155351 | 1422 | 473 | 466 | 57 |
| 360, 361 | amylase | Bacillus thuringiensis | 2.4.1.18 | 580662 | 0 | 2635411 | 1938 | 645 | 648 | 98 |
| 362, 363 | hypothetical protein [Microbulbifer degradans 2-40] | Microbulbifer degradans 2-40 | 3.2.1.1 | 23027235 | 1E-65 | 13362592 | 2094 | 697 | 643 | 33 |
| 364, 365 | Sequence 6 from patent US 5753460 | | 3.2.1.1 | 3994289 | 0 | 722278 | 1536 | 511 | 549 | 69 |
| 366, 367 | ALPHA-AMYLASE PRECURSOR (1,4-ALPHA-D-GLUCAN GLUCANOHYDROLASE) | Pseudoalteromonas haloplanktis | 3.2.1.1 | 6226551 | 0 | 2467084 | 1992 | 663 | 669 | 70 |
| 368, 369 | hypothetical protein [Burkholderia fungorum] | Burkholderia fungorum | 3.2.1.1 | 22986674 | 7E-28 | 14547281 | 1257 | 418 | 1146 | 27 |

FIGURE 35H

| | | | | | | | | |
|---|---|---|---|---|---|---|---|---|
| 370, 371 | alpha-amylase A [Halothermothrix orenii] | Halothermothrix orenii | | 243306106 | 1E-107 | 216309 | 1614 | 537 | 515 | 41 |
| 372, 373 | hypothetical protein [Microbulbifer degradans 2-40] | Microbulbifer degradans 2-40 | 3.2.1.1 | 23027235 | 6E-77 | 166984 | 1437 | 478 | 643 | 42 |
| 374, 375 | amylase precursor | Aeromonas hydrophila | 3.2.1.1 | 141870 | 0 | 141869 | 1398 | 465 | 464 | 91 |
| 376, 377 | hypothetical protein [Microbulbifer degradans 2-40] | Microbulbifer degradans 2-40 | 3.2.1.1 | 23027235 | 6E-52 | 13702782 | 1551 | 516 | 643 | 32 |
| 378, 379 | hypothetical protein [Microbulbifer degradans 2-40] | Microbulbifer degradans 2-40 | 3.2.1.1 | 23027235 | 1E-124 | 20334 | 1269 | 422 | 643 | 53 |
| 380, 381 | periplasmic alpha-amylase precursor [Xanthomonas campestris] | Xanthomonas campestris | 3.2.1.1 | 1166403 | 1E-140 | 1168402 | 1644 | 547 | 526 | 49 |
| 382, 383 | putative bi-functional protein (secreted alpha-amylase/dextrinase) [Streptomyces coelicolor A3(2)] | Streptomyces coelicolor A3(2) | 3.2.1.1 | 21220698 | 0 | 288182 | 4176 | 1391 | 1798 | 50 |
| 384, 385 | alpha-amylase [Xanthomonas campestris pv. campestris] | Xanthomonas campestris pv. campestris | 3.2.1.1 | 19224331 | 0 | 155351 | 1434 | 477 | 475 | 65 |
| 386, 387 | hypothetical protein [Chloroflexus aurantiacus] | Chloroflexus aurantiacus | 3.2.1.1 | 22970588 | 1E-162 | 1771460 | 1458 | 485 | 575 | 59 |

FIGURE 35I

| | | | | | | | | |
|---|---|---|---|---|---|---|---|---|
| 388, 389 | GLUCAN 1,4-ALPHA-MALTOTETRAHY DROLASE PRECURSOR (G4 AMYLASE) (MALTOTETRAOS E-FORMING AMYLASE) (EXO-MALTOTETRAOH YDROLASE) (MALTOTETRAOS E-FORMING EXO-AMYLASE) | Pseudomonas stutzeri | 3.2.1.1 | 2506188 | 0 | 45821 | 1662 | 553 | 548 | 92 |
| 390, 391 | alpha-amylase [Xanthomonas axonopodis pv. citri str. 306] | Xanthomonas axonopodis pv. citri str. 306 | 3.2.1.1 | 21106921 | 1E-177 | 155351 | 1497 | 498 | 475 | 61 |
| 392, 393 | hypothetical protein [Nostoc punctiforme] | Nostoc punctiforme | 3.2.1.1 | 23126762 | 8E-28 | 7799230 | 2100 | 699 | 552 | 29 |
| 394, 395 | hypothetical protein [Microbulbifer degradans 2-40] | Microbulbifer degradans 2-40 | 3.2.1.1 | 23027235 | 1E-147 | 14023709 | 1347 | 448 | 643 | 60 |
| 396, 397 | hypothetical protein [Microbulbifer degradans 2-40] | Microbulbifer degradans 2-40 | 2.4.1.18 | 23027244 | 1E-151 | 11433676 | 1644 | 547 | 566 | 48 |
| 398, 399 | hypothetical protein [Nostoc punctiforme] | Nostoc punctiforme | 3.2.1.1 | 23126762 | 5E-28 | 13276803 | 2040 | 679 | 552 | 32 |
| 400, 401 | hypothetical protein [Microbulbifer degradans 2-40] | Microbulbifer degradans 2-40 | 3.2.1.1 | 23027235 | 1E-140 | 13507463 | 1245 | 414 | 643 | 57 |

FIGURE 35J

| | | | | | | | | |
|---|---|---|---|---|---|---|---|---|
| 402, 403 | ALPHA-AMYLASE PRECURSOR (1,4-ALPHA-D-GLUCAN GLUCANOHYDRO LASE) | Pseudoalteromon as haloplanktis | 3.2.1.1 | 6226551 | 0 | 2467084 | 1995 | 664 | 669 | 66 |
| 404, 405 | hypothetical protein [Microbulbifer degradans 2-40] | Microbulbifer degradans 2-40 | 3.2.1.1 | 23027244 | 1E-155 | 2337886 | 1653 | 550 | 566 | 48 |
| 406, 407 | amylase precursor | Aeromonas hydrophila | 3.2.1.1 | 141870 | 0 | 141869 | 1398 | 465 | 464 | 94 |
| 408, 409 | alpha-amylase [Xanthomonas axonopodis pv. citri str. 306] | Xanthomonas axonopodis pv. citri str. 306 | 3.2.1.1 | 21106921 | 0 | 155351 | 1476 | 491 | 475 | 64 |
| 410, 411 | hypothetical protein [Microbulbifer degradans 2-40] | Microbulbifer degradans 2-40 | 3.2.1.1 | 23027235 | 0 | 14861204 | 1875 | 624 | 643 | 59 |
| 412, 413 | hypothetical protein [Chloroflexus aurantiacus] | Chloroflexus aurantiacus | 3.2.1.1 | 229971473 | 0 | 8250619 | 2088 | 695 | 627 | 53 |
| 414, 415 | hypothetical protein [Nostoc punctiforme] | Nostoc punctiforme | 3.2.1.1 | 23126762 | 3E-38 | 14091925 | 2262 | 753 | 552 | 25 |
| 416, 417 | beta-agarase [Pseudomonas sp. W7] | Pseudomonas sp. W7 | 3.2.1.1 | 9081816 | 5E-31 | 14518450 | 1344 | 447 | 642 | 27 |
| 418, 419 | alpha-amylase [Xanthomonas campestris pv. campestris] | Xanthomonas campestris pv. campestris | 3.2.1.1 | 19224331 | 1E-169 | 155351 | 1455 | 484 | 475 | 60 |

FIGURE 35K

| | | | | | | | | |
|---|---|---|---|---|---|---|---|---|
| 420, 421 | hypothetical protein [Microbulbifer degradans 2-40] | Microbulbifer degradans 2-40 | 3.2.1.1 | 23027235 | 1E-149 | 18699 | 1308 | 435 | 643 | 57 |
| 422, 423 | secreted alpha-amylase, [Streptomyces coelicolor A3(2)] | Streptomyces coelicolor A3(2) | 3.2.1.1 | 21225304 | 4E-87 | 6855158 | 2751 | 916 | 993 | 14 |
| 424, 425 | cyclomaltodextrin glucanotransferase (EC 2.4.1.19) precursor [validated] - Bacillus circulans (strain 8) | Bacillus circulans | 2.4.1.19 | 279549 | 0 | 39565 | 2169 | 722 | 718 | 80 |
| 426, 427 | alpha-amylase, Alpha amylase, catalytic domain [Bacillus anthracis A2012] | Bacillus anthracis str. A2012 | 3.2.1.41 | 21400626 | 1E-151 | 10728478 | 2139 | 712 | 724 | 42 |
| 428, 429 | alpha-amylase [Xanthomonas campestris pv. campestris] | Xanthomonas campestris pv. campestris | 3.2.1.1 | 19224331 | 1E-142 | 9789644 | 1425 | 474 | 475 | 52 |
| 430, 431 | alpha-amylase [Bacillus sp. TS-23] | Bacillus sp. TS-23 | 3.2.1.1 | 722279 | 0 | 722278 | 1650 | 550 | 613 | 85 |
| 432, 433 | alpha-amylase (EC 3.2.1.1) precursor - Streptomyces violaceus | Streptomyces violaceus | 3.2.1.1 | 80864 | 0 | 7619766 | 1752 | 583 | 569 | 64 |

FIGURE 35L

| 434, 435 | alpha-amylase (EC 3.2.1.1) Isozyme III | rice | Oryza sativa | 3.2.1.1 | 11263719 | 1E-110 | 3769329 | 1302 | 433 | 437 | 48 |

FIGURE 35M

| | | | | | | | | | | | |
|---|---|---|---|---|---|---|---|---|---|---|---|
| 438, 439 | hypothetical protein [Chloroflexus aurantiacus] | 22970478 | 1E-166 | Chloroflexus aurantiacus | | AAW83 330 | 1E-157 | Thermus rubens glucanotransferase gene amplifying Xba PCR primer. | AAD04 867 | 4E-04 | 2.4.1.2 5 | 1539 | 1806 | 601 | 54 | 58 |
| 440, 441 | Crystal Structure Of Amyk38 N289h Mutant | 34811325 | 6E-19 | | Alpha-amylase K38AMY mutagenic PCR primer AAO210Q209. | AAO210 08 | 8E-20 | Shewanella sp. SCRC-21406 (FERM BP-5979) ORFb DNA SEQ ID NO:4. | AAA92 470 | 0.87 | 3.2.1.1 | 3447 | 1148 | 7875 | 480 | 13 | |
| 442, 443 | GLUCAN 1,4-ALPHA-MALTOTETRA HYDROLASE PRECURSOR, MALTOTETRA OSE-FORMING AMYLASE, MALTOTETRA OSE-FORMING EXO-AMYLASE | 2506188 | 0 | Pseudomonas stutzeri | Maltotetraose. | AAR072 82 | 0 | Maltotetraose. | AAQ06 095 | 0 | 3.2.1.1 | 1668 | 555 | 548 | 75 | 78 |

FIGURE 35N

| | | | | | | | | | | | | |
|---|---|---|---|---|---|---|---|---|---|---|---|---|
| 444, 445 | alpha-amylase, Thermoactinomyces vulgaris. | 322327 | 1E-107 | Thermoactinomyces vulgaris | Alpha amylase DNA PCR primer #1. | ABU030 92 | 1E-121 | Human cDNA encoding secreted/transmembrane protein #76. | ABX16 619 | 0.38 | 2.4.1.1 9 | 1521 | 506 | 2196 | 502 | 44 | 43 |
| 446, 447 | alpha-amylase, Thermoactinomyces vulgaris. | 322327 | 5E-74 | Thermoactinomyces vulgaris | Alpha amylase DNA PCR primer #1. | ABU030 92 | 3E-56 | NOVX related reverse PCR primer SEQ ID No 149. | ABT16 037 | 0.89 | 2.4.1.1 9 | 3537 | 1178 | | 482 | 14 | 35 |
| 448, 449 | AmyM [uncultured bacterium]. | 37183425 | 1E-158 | uncultured bacterium | Alpha amylase DNA PCR primer #1. | ABU031 33 | 1E-126 | Human cDNA SEQ ID NO 201. | ABQ93 381 | 0.099 | 2.4.1.2 5 | 1575 | 524 | 1554 | 517 | 51 | 57 |
| 450, 451 | alpha-amylase 3 [Bacteroides thetaiotaomicron VPI-5482] | 29346183 | 1E-151 | Bacteroides thetaiotaomicron VPI-5482 | Alpha amylase DNA PCR primer #1. | ABU031 34 | 4E-16 | cDNA encoding human transporter polypeptide. | AAS16 905 | 0.47 | | 1890 | 629 | | 565 | 43 | 49 |
| 452, 453 | AmyA [uncultured bacterium] | 37222142 | 1E-135 | uncultured bacterium | Alpha amylase DNA PCR primer #1. | ABU031 31 | 1E-72 | Alpha amylase DNA PCR primer #1. | ABX08 502 | 0.007 | 3.2.1.1 | 1734 | 577 | | 608 | 43 | 56 |

FIGURE 350

| | | | | | | | | | | | | |
|---|---|---|---|---|---|---|---|---|---|---|---|---|
| 454, 455 | alpha-amylase [Hordeum vulgare]. | 295804 | 1E-116 | Hordeum vulgare | Endoxylo glucan transfera se sequenc e #165. | AAM001 08 | 1E-118 | Partial sequence of tomato Ca2+ ATPase. | AAZ29 771 | 0.33 | 3.2.1.1 | 1341 | 446 | 6263 | 430 | 47 | 53 |
| 456, 457 | AmyA [uncultured bacterium] | 37222142 | 1E-136 | uncultu red bacteri um | Alpha amylase DNA PCR primer #1. | ABU031 31 | 2E-73 | Alpha amylase DNA PCR primer #1. | ABX08 502 | 0.028 | 3.2.1.1 | 1734 | 577 | | 608 | 44 | 56 |
| 458, 459 | ALPHA-AMYLASE PRECURSOR (1,4-ALPHA-D-GLUCAN GLUCANOHYD ROLASE). | 113814 | 3E-81 | Bacillu s megate rium | Alpha amylase DNA PCR primer #1. | ABU031 15 | 7E-85 | Alpha amylase DNA PCR primer #1. | ABX08 486 | 0.002 | 3.2.1.1 | 1698 | 565 | 1620 | 539 | 30 | 47 |
| 460, 461 | maltase [Aspergillus oryzae]. | 14278921 | 1E-133 | Asperg illus oryzae | Vibrio harveyi endogluc anase DNA. | AAW34 990 | 1E-108 | Chromos ome 13q31-q33 biallelic marker containin g amplicon SEQ ID 182. | AAH51 601 | 0.11 | 3.2.1.2 0 | 1752 | 583 | 1725 | 574 | 43 | 53 |

FIGURE 35P

| | | | | | | | | | | | |
|---|---|---|---|---|---|---|---|---|---|---|---|
| 462-466 | 38524238 | 1E-143 | related to glucoamylase precursor [Neurospora crassa] | AAM515 #4. | 96 | 2E-39 | Thielavia terrestris glucoamylase DNA PCR primer SEQ ID NO 3150. | ABZ54 259. | 0.001 | | 1206 | 401 | | 405 | 60 | 63 |
| 467-474 | 38105244 | 1E-177 | hypothetical protein MG03287.4 [Magnaporthe grisea 70-15] | AAR093 59 | Sequence of amylase gene and upstream regulatory DNA. | AAR093 #42. | 1E-125 | Alpha amylase DNA PCR primer #1. | ABX08 477 | 0.61 | 3.2.1.1 | 2421 | 806 | | 518 | 36 | 39 |
| 475-479 | 16418019 | 0 | putative alpha-1,3-glucan synthase [Aspergillus fumigatus]. | ABU065 20 | Maize Starch synthase IIb (SSIIb) LINKR domain related protein | | 3E-13 | Aspergillus oryzae polynucleotide SEQ ID NO 3150. | ABZ53 554 | 5E-04 | 2.4.1.1 63 | 7131 | 2376 | 7281 | 2426 | 59 | 59 |
| 480-485 | 38101134 | 1E-175 | hypothetical protein MG10209.4 [Magnaporthe grisea 70-15] | AAB842 06 | Amino acid sequence of a Magnaporthe grisea 70-15 fungamyl-like alpha-amylase. | | 1E-103 | Fusarium venenatum EST SEQ ID NO:1176. | AAF07 664 | 5E-65 | 3.2.1.1 | 1383 | 460 | | 600 | 62 | 62 |

FIGURE 35Q

| | | | | | | | | | | |
|---|---|---|---|---|---|---|---|---|---|---|
| 486-493 | GLUCOAMYLASE P PRECURSOR (GLUCAN 1,4-ALPHA-GLUCOSIDASE) (1,4-ALPHA-D GLUCAN GLUCOHYDROLASE). | 461509 | 1E-144 | Amorphotheca resinae | cDNA encoding a glucoamylase P. | AAW30155 | 0 | cDNA encoding glucoamylase P. | AAT90830 | 5E-04 | 3.2.1.3 | 1932 | 643 | 616 | 61 | 60 |
| 494-499 | alpha-amylase AmyA [Emericella nidulans]. | 6561867 | 1E-145 | Emericella nidulans | Mutant alpha-amylase. | AAR46065 | 1E-142 | Fusarium venenatum EST SEQ ID NO:1176. | AAF12832 | 4E-04 | 3.2.1.1 | 1479 | 492 | 1473 | 49 | 54 |
| 500-510 | alpha-glucosidase [Schizosaccharomyces pombe]. | 19111855 | 1E-125 | Schizosaccharomyces pombe | PCR primer B1 from J092340s81. | AAW27300 | 1E-123 | Drosophila melanogaster polypeptide de SEQ ID NO 24465. | ABL18081 | 0.002 | 3.2.1.2 | 1833 | 610 | 1740 | 42 | 50 |
| 511-518 | acid-stable alpha-amylase [Aspergillus kawachii]. | 2570150 | | Aspergillus kawachii | Amino acid sequence of a fungamyl like alpha-amylase. | AAB84206 | 1E-122 | Arabidopsis thalliana stress regulated gene SEQ ID NO 1888. | ABZ16178 | 1.6 | 3.2.1.1 | 1650 | 549 | 1923 | 640 | 43 | 51 |

FIGURE 35R

| | | | | | | | | | | | |
|---|---|---|---|---|---|---|---|---|---|---|---|
| alpha-amylase AmyA [Emericella nidulans]. | 517, 518 | 6561867 | 1E-110 | Emericella nidulans | Alpha-amylase variant with leucine at position 84. | AAR241 36 | 1E-110 | S. pneumoniae type 4 strain protein from coding region #1864. | ABS56 454 | 0.44 | 3.2.1.1 | 1758 | 585 | 1473 | 490 | 37 | 42 |
| alpha-glucosidase [Aspergillus oryzae]. | 519-523 | 23503475 | 1E-179 | Aspergillus oryzae | PCR primer B1 from J092340 81. | AAW27 300 | 1E-129 | Fusarium venenatum EST SEQ ID NO:1176. | AAF08 465 | 0.002 | 3.2.1.2 0 | 1788 | 595 | 1809 | 602 | 50 | 56 |
| OLIGO-1,6-GLUCOSIDASE (SUCRASE-ISOMALTASE) (LIMIT DEXTRINASE) (ISOMALTASE) (DEXTRIN 6-ALPHA-D-GLUCANOHYDROLASE). | 524-528 | 129007 | 1E-145 | Geobacillus thermoglucosidasius | PCR primer B1 from J092340 81. | AAW27 300 | 1E-138 | Bacillus licheniformis genomic sequence tag (GST) #933. | ABK73 353 | 0.007 | 3.2.1.1 0 | 1755 | 584 | | 562 | 46 | 51 |
| alpha-glucosidase [Aspergillus oryzae]. | 529-533 | 23503475 | 1E-165 | Aspergillus oryzae | PCR primer B1 from J092340 81. | AAW27 300 | 1E-141 | Aspergillus oryzae polynucleotide SEQ ID NO 3150. | ABZ54 241 | 5E-07 | 3.2.1.2 0 | 1797 | 598 | 1809 | 602 | 48 | 55 |

FIGURE 35S

| | | | | | | | | | | | | |
|---|---|---|---|---|---|---|---|---|---|---|---|---|
| 534-540 | hypothetical protein MG10209.4 [Magnaporthe grisea 70-15] | 38101134 | 0 | Magnaporthe grisea 70-15 | Amino acid sequence of a fungamyl like alpha-amylase. | AAB84206 | 1E-105 | Fusarium venenatum EST SEQ ID NO:1176. | AAF07664 | 5E-13 | 3.2.1.1 | 1770 | | 600 | 65 | 68 |
| 541-545 | hypothetical protein [Neurospora crassa] gb|EAA32559.1| | 32411795 | 0 | Neurospora crassa | HIV multifunctional fusion polypeptide. | AAR13230 | 1E-137 | HIV multifunctional fusion polypeptide. | AAQ12770 | 1E-04 | 3.2.1.2 | 1992 | 663 | 608 | 60 | |
| 546-553 | glucan 1,4-alpha-glucosidase (EC 3.2.1.3) precursor - Neurospora crassa. | 486943 | 0 | Neurospora crassa | Thielavia terrestris glucoamylase DNA PCR primer #4. | AAM51596 | 0 | Thielavia terrestris glucoamylase DNA PCR primer #4. | ABA01139 | 5E-07 | 3.2.1.3 | 2019 | 672 | 626 | 58 | 36 |
| 554-559 | maltase [Aspergillus oryzae]. | 14278921 | 0 | Aspergillus oryzae | HIV multifunctional fusion polypeptide. | AAR13230 | 1E-147 | Fusarium venenatum EST SEQ ID NO:1176. | AAF13291 | 5E-04 | 3.2.1.2 | 1797 | 598 | 1725 | 574 | 57 | 59 |

FIGURE 35T

| | | | | | | | | | | | |
|---|---|---|---|---|---|---|---|---|---|---|---|
| 560-566 | ALPHA-AMYLASE A PRECURSOR (1,4-ALPHA-D-GLUCAN GLUCANOHYDROLASE A). | 1703298 | 1E-125 | Aspergillus niger var. awamori | Amino acid sequence of a fungamyl-like alpha-amylase. | AAB84206 | 1E-125 | Vector: pPR70-4 xlnB expression element region. | AAV61459 | 0.38 | 3.2.1.1 | 1524 | 507 | | 498 | 46 |
| 567, 568 | beta-agarase [Pseudomonas sp. W7] | 9081816 | 1E-126 | Pseudomonas sp. W7 | Alpha amylase DNA PCR primer #1. | ABU03140 | 1E-113 | Human secreted protein SEQ ID NO 792. | ABZ66894 | 1.4 | 3.2.1.1 | 1446 | 481 | 1926 | 642 | 49 | 57 |
| 569, 570 | | 40189607 | 0 | | | | | | | | | | 364 | 1095 | 364 | 100 | 100 |
| 571, 572 | alpha-amylase, [Bacillus sp. TS-23] | 722279 | 0 | Bacillus sp. TS-23 | Alpha amylase DNA PCR primer #1. | ABU03102 | 0 | Alpha amylase DNA PCR primer #1. | ABX08491 | 3E-11 | 3.2.1.1 | 1839 | 612 | 1842 | 613 | 59 | 56 |
| 573, 574 | CYCLOMALTODEXTRIN GLUCANOTRANSFERASE PRECURSOR (CYCLODEXTRIN GLYCOSYLTRANSFERASE) (CGTASE). | 1351937 | 0 | Thermoanaerobacterium thermosulfurigenes | Thermoanaerobacter CGTase variant G180S. | AAW06772 | 0 | Thermoanaerobacter CGTase variant G180S. | AAT44121 | 0 | 2.4.1.9 | 2133 | 710 | | 710 | 100 | 79 |

FIGURE 35U

| | | | Nucleotide sequence of | | | | | | Nucleotide sequence of | | | | | |
|---|---|---|---|---|---|---|---|---|---|---|---|---|---|---|
| 575, 576 | alpha-amylase [Bacillus sp. TS-23]. | 722279 | Bacillus sp. TS-23 | AAB676 55 | 7E-77 | 0 | | | an alpha-amylase of Bacillus NCIMB 40916. | AAF55 662 | 0 | 3.2.1.1 | 1677 | 558 | 1764 | 587 | 99 | 97 |
| 577, 578 | cyclodextrin glucanosyltransferase [Bacillus circulans]. | 11139208 | A cyclomaltodextrin glucanotransferase [Bacillus circulans (CTGase) variant. | AAY025 99 | 0 | | | Plasmid pTN603 encoding novel amylase gene. | AAN60 705 | 2E-10 | 2.4.1.1 9 | 2160 | 719 | 2142 | 713 | 67 | 88 |
| 579, 580 | AMYLOPULLULANASE PRECURSOR (ALPHA-AMYLASE/PULLULANASE) | 114076 | Thermoanaerobacter thermohydrosulfuricus Alpha amylase pullulanase gene. | AAR082 21 | 0 | | | Alpha amylase pullulana se gene. | AAQ06 827 | 0 | 3.2.1.1 35 | 5010 | 1669 | | 1475 | 87 | 90 |

FIGURE 35V

| | | | | | | | | | | | |
|---|---|---|---|---|---|---|---|---|---|---|---|
| 581, 582 | CYCLOMALTO DEXTRIN GLUCANOTRA NSFERASE PRECURSOR (CYCLODEXTR IN- GLYCOSYLTR ANSFERASE) (CGTASE). | 399222 | 0 | Bacillu s sp. 17-1 | Cycloma ltodextrin glucotra nsferase gene. | AAR100 17-1 52 | 0 | Sequenc e encoding cyclomalt odextrin glucanotr ansferas e (CGTase ) having alkaline optimum pH. | AAQ01 810 | 0 | 2.4.1.1 9 | 2142 | 713 | 713 | | 95 | 89 |
| 583, 584 | amylopullulanas e [Geobacillus stearothermoph ilus]. | 12006232 | 0 | Geoba cillus stearot hermo philus | Alpha amylase pullulana se gene. | AAR082 21 | 0 | | | | | | | | | | 46 |
| 585, 586 | alpha-amylase [Bacillus sp. TS-23]. | 722279 | 0 | Bacillu s sp. TS-23 | Alpha amylase DNA PCR primer #1. | ABU030 91 | 0 | Alpha amylase DNA PCR primer #1. | ABX08 462 | 0 | 3.2.1.1 2 0 | 6618 | 2205 | 6057 | 2018 | 29 | |
| | | | | | | | | Nucleotoid e sequenc e of an alpha- amylase of Bacillus sp. NCIMB 40916. | | | | 1860 | 619 | 1842 | 613 | 82 | 75 |
| 603, 604 | alpha-amylase [Bacillus sp. TS-23]. | 722279 | 1E-77 | Bacillu s sp. TS-23 | Nucleotoid e sequenc e of an alpha- amylase of Bacillus sp. NCIMB 40916. | AAB676 55 | 0 | | AAF55 662 | 0 | 3.2.1.1 | 1773 | 590 | 1764 | 587 | 97 | 95 |

FIGURE 35W

| | | | | | | | | | | |
|---|---|---|---|---|---|---|---|---|---|---|
| 805, 806 | CYCLOMALTO DEXTRIN GLUCANOTRA NSFERASE PRECURSOR (CYCLODEXTR IN-GLYCOSYLTR ANSFERASE) (CGTASE). | 399219 | 0 | A cyclomal todextrin glucanot ransfera se Bacillu s circula (CTGase AAY025 ns ) variant. 99 | 0 | Plasmid pTN603 encoding novel amylase AAN60 gene. 705 | 8E-85 | 2.4.1.1 9 | 2160 | 719 | 718 | 74 | 70 |
| 607, 608 | amylopullulanas e [Geobacillus stearothermoph ilus]. | 12006232 | 7E-77 | Alpha amylase Geoba DNA cillus PCR stearot primer ABU030 hermo #1. phllus 83 | 0 | Alpha amylase DNA PCR primer ABX08 #1. 454 | 0 | 3.2.1.1 35 | 3708 | 1235 | 6057 | 2018 | 77 | 71 |
| | | | | Nucletoi de sequenc e of an alpha-amylase Bacillu of s sp. Bacillus TS-23 NCIMB AAB676 40916. 55 | 0 | Nucletoid e sequence of an alpha-amylase of Bacillus NCIMB AAF55 40916. 662 | 0 | | | | | | 97 |
| 609, 610 | alpha-amylase [Bacillus sp. TS-23]. | 722279 | | | | | | 3.2.1.1 35 | 1764 | 587 | 1764 | 587 | 98 |
| 611, 612 | hypothetical protein - Bacillus sp. | 2126830 | 0 | Alpha amylase DNA PCR Bacillu primer ABU030 s sp. #1. 83 | 0 | Alpha amylase DNA PCR primer ABX08 #1. 454 | 0 | 3.2.1.1 35 | 3807 | 1268 | 2032 | 75 |

FIGURE 35X

| | | | | | | | | | | | | |
|---|---|---|---|---|---|---|---|---|---|---|---|---|
| 613, 614 | alpha-amylase [Bacillus sp. TS-23] | 722279 | 3E-77 | Bacillus sp. TS-23 | Nucleotide sequence of an alpha-amylase of Bacillus NCIMB 40916. | AAB676 55 | 0 | Nucleotide sequence of an alpha-amylase of Bacillus NCIMB 40916. | AAF55 662 | 0 | 3.2.1.1 | 1764 | 587 | 1764 | 587 | 99 | 97 |
| 615, 616 | ALPHA-AMYLASE PRECURSOR (1,4-ALPHA-D-GLUCAN GLUCANOHYDROLASE). | 113822 | 0 | Streptomyces violaceus | Amylase from Streptomyces griseus IMRU 3570. | AAR082 63 | 0 | Amylase from Streptomyces limosus. | AAN80 309 | 2E-61 | 3.2.1.1 | 1752 | 583 | | 569 | 64 | 72 |
| 617, 618 | GLUCAN 1,4-ALPHA-MALTOTETRA HYDROLASE PRECURSOR (G4-AMYLASE) (MALTOTETRAOSE-FORMING AMYLASE) (EXO-MALTOTETRAOHYDROLASE) (MALTOTETRAOSE-FORMING EXO-AMYLASE). | 113760 | 0 | Pseudomonas saccharophila | Maltotetraose. | AAR072 82 | 0 | Maltotetraose. | AAQ06 095 | 0 | 3.2.1.1 | 1668 | 555 | | 551 | 74 | 78 |

FIGURE 35Y

| | | Streptomyces violaceus | Amylase from Streptomyces griseus IMRU 3570. AAR082 63 | | Amylase from Streptomyces griseus IMRU 3570. AAQ06 844 | | | | | | | |
|---|---|---|---|---|---|---|---|---|---|---|---|---|
| 619, 620 | ALPHA-AMYLASE PRECURSOR (1,4-ALPHA-D-GLUCAN GLUCANOHYDROLASE). | 113822 | | | | | | | | | | |
| 621, 622 | alpha-amylase [Bacillus sp. TS-23]. | 722279 | 3E-77 | Bacillus sp. TS-23 | | Nucletoide sequence of an alpha-amylase of Bacillus NCIMB 40916. AAB676 55 | 0 | Nucletoide sequence of an alpha-amylase of Bacillus NCIMB 40916. AAF55 662 | 0 | 3.2.1.1 | 1716 | 571 | 569 | 91 | 81 |
| | | | | | | | | | | 3.2.1.1 | 1773 | 590 | 587 | 98 | 97 |

AMYLASES, NUCLEIC ACIDS ENCODING THEM AND METHODS FOR MAKING AND USING THEM

RELATED APPLICATIONS

This application is a national phase application claiming benefit of priority under 35 U.S.C. §371 to Patent Convention Treaty (PCT) International Application Serial No: PCT/US2004/007096, filed Mar. 8, 2004 (published as WO 2004/091544, on Oct. 28, 2004), which is a continuation of U.S. patent application Ser. No. 10/385,305, filed Mar. 6, 2003, now U.S. Pat. No. 7,560,126, which claims benefit of priority to U.S. Provisional Patent Application Ser. No. ("USSN") 60/459,014, filed Mar. 28, 2003. The aforementioned applications are explicitly incorporated herein by reference in their entirety and for all purposes.

REFERENCE TO SEQUENCE LISTING SUBMITTED ON A COMPACT DISC

This application includes a compact disc (submitted in quadruplicate) containing a sequence listing. The entire content of the sequence listing is herein incorporated by reference. The sequence listing is identified on the compact disc as follows.

| File Name | Date of Creation | Size (bytes) |
|---|---|---|
| Sequence Listing.txt | Mar. 4, 2004 | 1,798,144 |

TECHNICAL FIELD

This invention relates to molecular and cellular biology and biochemistry. In one aspect, the invention is directed to polypeptides having an amylase activity, polynucleotides encoding the polypeptides, and methods for making and using these polynucleotides and polypeptides. In one aspect, the polypeptides of the invention can be used as amylases, for example, alpha amylases or glucoamylases, to catalyze the hydrolysis of starch into sugars. In one aspect, the invention is directed to polypeptides having thermostable amylase activity, such as alpha amylases or glucoamylase activity, e.g., a 1,4-alpha-D-glucan glucohydrolase activity. In one aspect, the polypeptides of the invention can be used as amylases, for example, alpha amylases or glucoamylases, to catalyze the hydrolysis of starch into sugars, such as glucose. The invention is also directed to nucleic acid constructs, vectors, and host cells comprising the nucleic acid sequences of the invention as well as recombinant methods for producing the polypeptides of the invention. The invention is also directed to the use of amylases of the invention in starch conversion processes, including production of high fructose corn syrup (HFCS), ethanol, dextrose, and dextrose syrups.

BACKGROUND

Starch is a complex carbohydrate often found in the human diet. The structure of starch is glucose polymers linked by α-1,4 and α-1,6 glucosidic bonds. Amylase is an enzyme that catalyzes the hydrolysis of starches into sugars. Amylases hydrolyze internal α-1,4-glucosidic linkages in starch, largely at random, to produce smaller molecular weight malto-dextrins. The breakdown of starch is important in the digestive system and commercially. Amylases are of considerable commercial value, being used in the initial stages (liquefaction) of starch processing; in wet corn milling; in alcohol production; as cleaning agents in detergent matrices; in the textile industry for starch desizing; in baking applications; in the beverage industry; in oilfields in drilling processes; in inking of recycled paper; and in animal feed.

Amylases are produced by a wide variety of microorganisms including *Bacillus* and *Aspergillus*, with most commercial amylases being produced from bacterial sources such as *Bacillus licheniformis, Bacillus amyloliquefaciens, Bacillus subtilis,* or *Bacillus stearothermophilus*. In recent years, the enzymes in commercial use have been those from *Bacillus licheniformis* because of their heat stability and performance, at least at neutral and mildly alkaline pHs.

Commercially, glucoamylases are used to further hydrolyze cornstarch, which has already been partially hydrolyzed with an alpha-amylase. The glucose produced in this reaction may then be converted to a mixture of glucose and fructose by a glucose isomerase enzyme. This mixture, or one enriched with fructose, is the high fructose corn syrup commercialized throughout the world. In general, starch to fructose processing consists of four steps: liquefaction of granular starch, saccharification of the liquefied starch into dextrose, purification, and isomerization to fructose. The object of a starch liquefaction process is to convert a concentrated suspension of starch polymer granules into a solution of soluble shorter chain length dextrins of low viscosity.

The most widely utilized glucoamylase is produced from the fungus *Aspergillus niger*. One of the problems with the commercial use of this enzyme is its relatively low thermostability. A number of other fungal glucoamylases have been reported, including *Rizopus, Thielavia, Thermoascus* and *Talaromyces,* and a glucoamylase from the thermophilic fungus *Thermomyces lanuginosus*.

In general, starch to fructose processing consists of four steps: liquefaction of granular starch, saccharification of the liquefied starch into dextrose, purification, and isomerization to fructose. The object of a starch liquefaction process is to convert a concentrated suspension of starch polymer granules into a solution of soluble shorter chain length dextrins of low viscosity. This step is essential for convenient handling with standard equipment and for efficient conversion to glucose or other sugars. To liquefy granular starch, it is necessary to gelatinize the granules by raising the temperature of the granular starch to over about 72° C. The heating process instantaneously disrupts the insoluble starch granules-to produce a water soluble starch solution. The solubilized starch solution is then liquefied by amylase. A starch granule is composed of: 69-74% amylopectin, 26-31% amylose, 11-14% water, 0.2-0.4% protein, 0.5-0.9% lipid, 0.05-0.1% ash, 0.02-0.03% phosphorus, 0.1% pentosan. Approximately 70% of a granule is amorphous and 30% is crystalline.

A common enzymatic liquefaction process involves adjusting the pH of a granular starch slurry to between 6.0 and 6.5, the pH optimum of alpha-amylase derived from *Bacillus licheniformis,* with the addition of calcium hydroxide, sodium hydroxide or sodium carbonate. The addition of calcium hydroxide has the advantage of also providing calcium ions which are known to stabilize the alpha-amylase against inactivation. Upon addition of alpha-amylase, the suspension is pumped through a steam jet to instantaneously raise the temperature to between 80° C. to 115° C. The starch is immediately gelatinized and, due to the presence of alpha-amylase, depolymerized through random hydrolysis of a (1-4) glycosidic bonds by alpha-amylase to a fluid mass which is easily pumped.

In a second variation to the liquefaction process, alpha-amylase is added to the starch suspension, the suspension is held at a temperature of 80-100° C. to partially hydrolyze the starch granules, and the partially hydrolyzed starch suspension is pumped through a jet at temperatures in excess of about 105° C. to thoroughly gelatinize any remaining granular structure. After cooling the gelatinized starch, a second addition of alpha-amylase can be made to further hydrolyze the starch.

A third variation of this process is called the dry milling process. In dry milling, whole grain is ground and combined with water. The germ is optionally removed by flotation separation or equivalent techniques. The resulting mixture, which contains starch, fiber, protein and other components of the grain, is liquefied using alpha-amylase. The general practice in the art is to undertake enzymatic liquefaction at a lower temperature when using the dry milling process. Generally, low temperature liquefaction is believed to be less efficient than high temperature liquefaction in converting starch to soluble dextrins.

Typically, after gelatinization the starch solution is held at an elevated temperature in the presence of alpha-amylase until a DE of 10-20 is achieved, usually a period of 1-3 hours. Dextrose equivalent (DE) is the industry standard for measuring the concentration of total reducing sugars, calculated as D-glucose on a dry weight basis. Unhydrolyzed granular starch has a DE of virtually zero, whereas the DE of D-glucose is defined as 100.

Corn wet milling is a process which produces corn oil, gluten meal, gluten feed and starch. Alkaline-amylase is used in the liquefaction of starch and glucoamylase is used in saccharification, producing glucose. Corn, a kernel of which consists of a outer seed coat (fiber), starch, a combination of starch and glucose and the inner germ, is subjected to a four step process, which results in the production of starch. The corn is steeped, de-germed, de-fibered, and finally the gluten is separated. In the steeping process, the solubles are taken out. The product remaining after removal of the solubles is de-germed, resulting in production of corn oil and production of an oil cake, which is added to the solubles from the steeping step. The remaining product is de-fibered and the fiber solids are added to the oil cake/solubles mixture. This mixture of fiber solids, oil cake and solubles forms a gluten feed. After de-fibering, the remaining product is subjected to gluten separation. This separation results in a gluten meal and starch. The starch is then subjected to liquefaction and saccharification to produce glucose.

Staling of baked products (such as bread) has been recognized as a problem which becomes more serious as more time lies between the moment of preparation of the bread product and the moment of consumption. The term staling is used to describe changes undesirable to the consumer in the properties of the bread product after leaving the oven, such as an increase of the firmness of the crumb, a decrease of the elasticity of the crumb, and changes in the crust, which becomes tough and leathery. The firmness of the bread crumb increases further during storage up to a level, which is considered as negative. The increase in crumb firmness, which is considered as the most important aspect of staling, is recognized by the consumer a long time before the bread product has otherwise become unsuitable for consumption.

There is a need in the industry for the identification and optimization of amylases, useful for various uses, including commercial cornstarch liquefaction processes. These second generation acid amylases will offer improved manufacturing and/or performance characteristics over the industry standard enzymes from *Bacillus licheniformis*, for example.

There is also a need for the identification and optimization of amylases having utility in automatic dish wash (ADW) products and laundry detergent. In ADW products, the amylase will function at pH 10-11 and at 45-60° C. in the presence of calcium chelators and oxidative conditions. For laundry, activity at pH 9-10 and 40° C. in the appropriate detergent matrix will be required. Amylases are also useful in textile desizing, brewing processes, starch modification in the paper and pulp industry and other processes described in the art.

Amylases can be used commercially in the initial stages (liquefaction) of starch processing; in wet corn milling; in alcohol production; as cleaning agents in detergent matrices; in the textile industry for starch desizing; in baking applications; in the beverage industry; in oilfields in drilling processes; in inking of recycled paper and in animal feed. Amylases are also useful in textile desizing, brewing processes, starch modification in the paper and pulp industry and other processes.

The publications discussed herein are provided solely for their disclosure prior to the filing date of the present application. Nothing herein is to be construed as an admission that the invention is not entitled to antedate such disclosure by virtue of prior invention.

SUMMARY

The invention provides isolated or recombinant nucleic acids comprising a 20 nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a nucleic acid of the invention, e.g., an exemplary 25 nucleic acid of the invention, over a region of at least about 10, 15, 20, 25, 30, 35, 40, 45, 50, 55, 60, 65, 70, 75, 100, 125, 150, 175, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. In one aspect, the nucleic acid encodes at least one polypeptide having an amylase activity, and the sequence identities are determined by 30 analysis with a sequence comparison algorithin or by a visual inspection. In another aspect, the invention provides nucleic acids for use as probes, inhibitory molecules (e.g., antisense, iRNAs), transcriptional or translational regulation, and the like. Exemplary nucleic acids of the invention include isolated or recombinant nucleic acids comprising a nucleic acid sequence as set forth in SEQ ID NO:1, SEQ ID NO:3, SEQ ID NO:5, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:911, SEQ ID NO:103, SEQ ID NO:9 O5, SEQ ID NO:107, SEQ ID NO:109, SEQ ID NO:101, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:189, SEQ ID NO:191, SEQ ID NO:193, SEQ ID NO:203, SEQ ID NO:205, SEQ ID NO:207, SEQ ID NO:209, SEQ ID NO:219, SEQ ID NO:322, SEQ ID NO:324, SEQ ID NO:326, SEQ ID NO:328, SEQ ID NO:332, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:460, SEQ ID NO:462, SEQ ID NO:465, SEQ ID NO:467, SEQ ID NO:473, SEQ ID NO:475, SEQ ID NO:478, SEQ ID NO:480, SEQ ID NO:484, SEQ ID NO:486, SEQ ID NO:492, SEQ ID NO:494, SEQ ID NO:498, SEQ ID NO:500, SEQ ID NO:509, SEQ ID NO:511, SEQ ID NO:515, SEQ ID NO:517, SEQ ID NO:517, SEQ ID NO:519, SEQ ID NO:522, SEQ ID NO:524, SEQ ID NO:527, SEQ ID NO:529, SEQ ID NO:532, SEQ ID NO:534, SEQ ID NO:539, SEQ ID NO:541, SEQ ID NO:544, SEQ ID NO:546, SEQ ID NO:552, SEQ ID NO:554, SEQ ID NO:558, SEQ ID NO:560, SEQ ID NO:565, SEQ ID NO:567, SEQ ID NO:569, SEQ ID NO:571, SEQ ID NO:573, SEQ ID NO:575, SEQ ID NO:577, SEQ ID NO:579, SEQ ID NO:581, SEQ ID NO:583, SEQ ID NO:585, SEQ ID NO:587, SEQ ID NO:593, SEQ ID NO:603, SEQ ID NO:605, SEQ ID NO:607, SEQ ID NO:609, SEQ ID NO:611, SEQ ID NO:613, SEQ ID NO:615, SEQ ID NO:617, SEQ ID NO:619 or SEQ ID NO:621, and subsequences thereof, e.g., at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500 or more residues in length, or over the full length of a gene or transcript.

Exemplary nucleic acids of the invention also include isolated or recombinant nucleic acids encoding a polypeptide of the invention, e.g., an exemplary polypeptide having a sequence as set forth in SEQ ID NO:2, SEQ ID NO:4, SEQ ID NO:6, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:190, SEQ ID NO:192, SEQ ID NO:194, SEQ ID NO:204, SEQ ID NO:206, SEQ ID NO:208, SEQ ID NO:210, SEQ ID NO:212, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:461, SEQ ID NO:463, SEQ ID NO:464, SEQ ID NO:466, SEQ ID NO:468, SEQ ID NO:469, SEQ ID NO:470, SEQ ID NO:471, SEQ ID NO:472, SEQ ID NO:474, SEQ ID NO:476, SEQ ID NO:477, SEQ ID NO:479, SEQ ID NO:481, SEQ ID NO:482, SEQ ID NO:483, SEQ ID NO:485, SEQ ID NO:487, SEQ ID NO:488, SEQ ID NO:489, SEQ ID NO:490, SEQ ID NO:491, SEQ ID NO:493, SEQ ID NO:495, SEQ ID NO:496, SEQ ID NO:497, SEQ ID NO:499, SEQ ID NO:501, SEQ ID NO:502, SEQ ID NO:503, SEQ ID NO:504, SEQ ID NO:504, SEQ ID NO:506, SEQ ID NO:507, SEQ ID NO:508, SEQ ID NO:504, SEQ ID NO:512, SEQ ID NO:513, SEQ ID NO:514, SEQ ID NO:516, SEQ ID NO:518, SEQ ID NO:518, SEQ ID NO:520, SEQ ID NO:521, SEQ ID NO:523, SEQ ID NO:525, SEQ ID NO:526, SEQ ID NO:520, SEQ ID NO:530, SEQ ID NO:531, SEQ ID NO:533, SEQ ID NO:535, SEQ ID NO:536, SEQ ID NO:537, SEQ ID NO:538, SEQ ID NO:540, SEQ ID NO:542, SEQ ID NO:543, SEQ ID NO:545, SEQ ID NO:547, SEQ ID NO:548, SEQ ID NO:549, SEQ ID NO:550, SEQ ID NO:551, SEQ ID NO:553, SEQ ID NO:555, SEQ ID NO:556, SEQ ID NO:557, SEQ ID NO:551, SEQ ID NO:561, SEQ ID NO:562, SEQ ID NO:563, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:589, SEQ ID NO:590, SEQ ID NO:591, SEQ ID NO:592, SEQ ID NO:594, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620 or SEQ ID NO:622, and subsequences thereof and variants thereof, and polypeptides having at least about 50% (or more, as described below) sequence identity to an exemplary polypeptide of the invention. In one aspect, the polypeptide has an amylase activity, e.g., an alpha amylase or glucoamylase activity (alternative amylase activities described further, below). In one aspect the polypeptide acts as an immunogen or epitope.

In one aspect, the invention also provides amylase-encoding nucleic acids with a common novelty in that they are derived from mixed cultures. The invention provides amylase-encoding nucleic acids isolated from mixed cultures comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention over a region of at least about 10, 15, 20, 25, 30, 35, 40, 45, 50, 55, 60, 65, 70, 75, 100, 150, 200, 250, 300, 350, 400, 450, 500, 550, 600, 650, 700, 750, 800, 850, 900, 950, 1000,1050, 1100, 1150, 1200, 1250, 1300, 1350, 1400, 1450, 1500, 1550 or more, residues, wherein the nucleic acid encodes at least one polypeptide having an amylase activity, and the sequence identities are determined by analysis with a sequence comparison algorithm or by a visual inspection. In one aspect, the invention provides amylase-encoding nucleic acids isolated from mixed cultures comprising a nucleic acid of the invention, e.g., an exemplary nucleic acid of the invention, e.g., a sequence as set forth in SEQ ID NO:1, SEQ ID NO:3, SEQ ID NO:5, SEQ ID NO:9, SEQ ID NO:11, etc., and subsequences thereof, e.g., at least about 10, 15, 20, 25, 30, 35, 40,45, 50, 75, 100, 150, 200,250, 300, 350, 400, 450, 500, 550, 600, 650, 700, 750, 800, 850, 900, 950, 1000, 1050, 1100, 1150, 1200, 1250, 1300, 1350, 1400, 1450, 1500 or more residues in length, or over the fuill length of a gene or transcript; or, a nucleic acid encoding a polypeptide of the invention.

In one aspect, the invention also provides amylase-encoding nucleic acids with a common novelty in that they are derived from environmental sources, e.g., mixed environmental sources. In one aspect, the invention provides amylase-encoding nucleic acids isolated from environmental sources, e.g., mixed environmental sources, comprising a nucleic acid sequence having at least about 50%, 51%, 52%, 53%, 54%, 55%, 56%, 57%, 58%, 59%, 60%, 61%,62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues, wherein the nucleic acid encodes at least one polypeptide having an amylase activity, and the sequence identities are determined by analysis with a sequence comparison algorithm or by a visual inspection. In one aspect, the invention provides amylase-encoding nucleic acids isolated from environmental sources, e.g., mixed environmental sources, comprising a nucleic acid of the invention, e.g., an exemplary nucleic acid sequence of the invention as set forth in SEQ ID NO:1, SEQ ID NO:3, SEQ ID NO:5, SEQ ID NO:9, SEQ ID NO:11, etc., SEQ ID NO:583, SEQ ID NO:585, and subsequences thereof, e.g., at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500 or more residues in length, or over the fuill length of a gene or transcript; or, a nucleic acid encoding a polypeptide of the invention.

In one aspect, the invention also provides amylases, and amylase-encoding nucleic acids, with a common novelty in that they are derived from archael sources, including the archael-derived amylases of SEQ ID NO:80 (encoded by SEQ ID NO:79), SEQ ID NO:82 (encoded by SEQ ID NO:81), SEQ ID NO:116 (encoded by SEQ ID NO:115), SEQ ID NO:323 (encoded by SEQ ID NO:322), SEQ NO: 570 (encoded by SEQ ID NO:169).

In one aspect, the sequence comparison algorithm is a BLAST version 2.2.2 algorithm where a filtering setting is set to blastall -p blastp -d "nr pataa"-F F, and all other options are set to default.

Another aspect of the invention is an isolated or recombinant nucleic acid including at least 10 consecutive bases of a nucleic acid sequence of the invention, sequences substantially identical thereto, and the sequences complementary thereto.

In one aspect, the amylase activity comprises a-amylase activity, including the ability to hydrolyze internal alpha-1,4-glucosidic linkages in starch to produce smaller molecular weight malto-dextrins. In one aspect, the a-amylase activity includes hydrolyzing internal alpha-1,4-glucosidic linkages in starch at random. The amylase activity can comprise an a-amylase activity, a β-amylase activity, a glucoamylase activity, a 1,4-a-D-glucan glucohydrolase activity, an exoamylase activity, a glucan a-maltotetrahydrolase activity, a maltase activity, an isomaltase activity, a glucan 1, 4, a-glucosidase activity, an a-glucosidase activity, a sucrase activity or an agarase activity (e.g., a β-agarase activity). The amylase activity can comprise hydrolyzing glucosidic bonds. In one aspect, the glucosidic bonds comprise an a-1,4-glucosidic bond. In another aspect, the glucosidic bonds comprise an a-i ,6-glucosidic bond. In one aspect, the amylase activity comprises hydrolyzing glucosidic bonds in starch, e.g., liquefied starch. The amylase activity can further comprise hydrolyzing glucosidic bonds into maltodextrins. In one aspect, the amylase activity comprises cleaving a maltose or a D-glucose unit from non-reducing end of the starch.

In one aspect, the isolated or recombinant nucleic acid encodes a polypeptide having an amylase activity which is thermostable. The polypeptide can retain an amylase activity under conditions comprising a temperature range of anywhere between about 0° C. to about 37° C., or, between about 37° C. to about 95° C. or more, e.g., 98° C., 100° C. or more; between about 55° C. to about 85° C., between about 70° C. to about 95° C., or, between about 90° C. to about 95° C. For example, the exemplary polypeptide having a sequence as set forth in SEQ ID NO:437 is thermostable, retaining 50% activity after 25 minutes at 100° C. in the absence of added calcium.

In another aspect, the isolated or recombinant nucleic acid encodes a polypeptide having an amylase activity which is thermotolerant. The polypeptide can retain an amylase activity after exposure to a temperature in the range from greater than 37° C. to about 95° C. or anywhere in the range from greater than 55° C. to about 85° C. In one aspect, the polypeptide retains an amylase activity after exposure to a temperature in the range from greater than 90° C. to about 95° C. at pH 4.5.

The invention provides isolated or recombinant nucleic acids comprising a sequence that hybridizes under stringent conditions to a nucleic acid of the invention, e.g., an exemplary nucleic acid of the invention, a nucleic acid comprising a sequence as set forth in SEQ ID NO:1, SEQ ID NO:3, SEQ ID NO:5, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:189, SEQ ID NO:191, SEQ ID NO:193, SEQ ID NO:203, SEQ ID NO:205, SEQ ID NO:207, SEQ ID NO:209, SEQ ID NO:211, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378, SEQ ID NO:380, SEQ ID NO:382, SEQ ID NO:384, SEQ ID NO:386, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:460, SEQ ID NO:462, SEQ ID NO:465, SEQ ID NO:467, SEQ ID NO:473, SEQ ID NO:475, SEQ ID NO:478, SEQ ID NO:480, SEQ ID NO:484, SEQ ID NO:486, SEQ ID NO:492, SEQ ID NO:494, SEQ ID NO:498, SEQ ID NO:500, SEQ ID NO:509, SEQ ID NO:511, SEQ ID NO:515, SEQ ID NO:517, SEQ ID NO:517, SEQ ID NO:519, SEQ ID NO:522, SEQ ID NO:524, SEQ ID NO:527, SEQ ID NO:529, SEQ ID NO:532, SEQ ID NO:534, SEQ ID NO:539, SEQ ID NO:541, SEQ ID NO:544, SEQ ID NO:546, SEQ ID NO:552, SEQ ID NO:554, SEQ ID NO:558, SEQ ID NO:560, SEQ ID NO:565, SEQ ID NO:567, SEQ ID NO:569, SEQ ID NO:571, SEQ ID NO:573, SEQ ID NO:575, SEQ ID NO:577, SEQ ID NO:579, SEQ ID NO:581, SEQ ID NO:583, SEQ ID NO:585, SEQ ID NO:587, SEQ ID NO:593, SEQ ID NO:603, SEQ ID NO:605, SEQ ID NO:607, SEQ ID NO:609, SEQ ID NO:611, SEQ ID NO:613, SEQ ID NO:615, SEQ ID NO:617, SEQ ID NO:619or SEQ ID NO:621, or fragments or subsequences thereof. In one aspect, the nucleic acid encodes a polypeptide having an amylase activity. The nucleic acid can be at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500 or more residues in length or the full length of the gene or transcript. In one aspect, the stringent conditions include a wash step comprising a wash in 0.2×SSC at a temperature of about 65° C. for about 15 minutes.

The invention provides a nucleic acid probe for identifying a nucleic acid encoding a polypeptide having an amylase activity, wherein the probe comprises at least about 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 or more, consecutive bases of a sequence comprising a sequence of the invention, or fragments or subsequences thereof, wherein the probe identifies the nucleic acid by binding or hybridization. The probe can comprise an oligonucleotide comprising at least about 10 to 50, about 20 to 60, about 30 to 70, about 40 to 80, or about 60 to 100 consecutive bases of a sequence comprising a sequence of the invention, or fragments or subsequences thereof.

The invention provides a nucleic acid probe for identifying a nucleic acid encoding a polypeptide having an amylase activity, wherein the probe comprises a nucleic acid comprising a sequence at least about 10, 15, 20, 25, 30, 35, 40, 45, 50, 55, 60, 65, 70, 75, 80, 90, 100, 125, 150, 175, 200, 250, 300, 350, 400, 450, 500, 550, 600, 650, 700, 750, 800, 850, 900, 950, 1000 or more residues having at least about 50%, 5 1%, 52%, 53%, 54%, 55%, 56%, 57%, 58%, 59%, 60%, 61%, 62%, 63%, 64%, 65%, 66%, 67%, 68%, 69%, 70%, 71%, 72%,73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a nucleic acid of the invention, wherein the sequence identities are determined by analysis with a sequence comparison algorithm or by visual inspection.

The probe can comprise an oligonucleotide comprising at least about 10 to 50, about 20 to 60, about 30 to 70, about 40 to 80, or about 60 to 100 consecutive bases of a nucleic acid sequence of the invention, or a subsequence thereof.

The invention provides an amplification primer sequence pair for amplifying a nucleic acid encoding a polypeptide having an amylase activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence.

The invention provides methods of amplifying a nucleic acid encoding a polypeptide having an amylase activity comprising amplification of a template nucleic acid with an amplification primer sequence pair capable of amplifying a nucleic acid sequence of the invention, or fragments or subsequences thereof.

The invention provides expression cassettes comprising a nucleic acid of the invention or a subsequence thereof. In one aspect, the expression cassette can comprise the nucleic acid that is operably linked to a promoter. The promoter can be a viral, bacterial, mammalian or plant promoter. In one aspect, the plant promoter can be a potato, rice, corn, wheat, tobacco or barley promoter. The promoter can be a constitutive promoter. The constitutive promoter can comprise CaMV35S. In another aspect, the promoter can be an inducible promoter. In one aspect, the promoter can be a tissue-specific promoter or an environmentally regulated or a developmentally regulated promoter. Thus, the promoter can be, e.g., a seed-specific, a leaf-specific, a root-specific, a stem-specific or an abscission-induced promoter. In one aspect, the expression cassette can further comprise a plant or plant virus expression vector.

The invention provides cloning vehicles comprising an expression cassette (e.g., a vector) of the invention or a nucleic acid of the invention. The cloning vehicle can be a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise a bacterial artificial chromosome (BAC), a plasmid, a bacteriophage P1-derived vector (PAC), a yeast artificial chromosome (YAC), or a manunalian artificial chromosome (MAC).

The invention provides transformed cell comprising a nucleic acid of the invention or an expression cassette (e.g., a vector) of the invention, or a cloning vehicle of the invention. In one aspect, the transformed cell can be a bacterial cell, a mammalian cell, a fungal cell, a yeast cell, an insect cell or a plant cell. In one aspect, the plant cell can be a potato, wheat, rice, corn, tobacco or barley cell.

The invention provides transgenic non-human animals comprising a nucleic acid of the invention or an expression cassette (e.g., a vector) of the invention. In one aspect, the animal is a mouse.

The invention provides transgenic plants comprising a nucleic acid of the invention or an expression cassette (e.g., a vector) of the invention. The transgenic plant can be a corn plant, a potato plant, a tomato plant, a wheat plant, an oilseed plant, a rapeseed plant, a soybean plant, a rice plant, a barley plant or a tobacco plant.

The invention provides transgenic seeds comprising a nucleic acid of the invention or an expression cassette (e.g., a vector) of the invention. The transgenic seed can be a corn seed, a wheat kernel, an oilseed, a rapeseed, a soybean seed, a palm kernel, a sunflower seed, a sesame seed, a peanut or a tobacco plant seed.

The invention provides an antisense oligonucleotide comprising a nucleic acid sequence complementary to or capable of hybridizing under stringent conditions to a nucleic acid of the invention. The invention provides methods of inhibiting the translation of an amylase message in a cell comprising administering to the cell or expressing in the cell an antisense oligonucleotide comprising a nucleic acid sequence complementary to or capable of hybridizing under stringent conditions to a nucleic acid of the invention.

The invention provides an isolated or recombinant polypeptide comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide or peptide of the invention over a region of at least about 10, 15, 20, 25, 30, 35, 40, 45, 50, 55, 60, 65, 70, 75, 80, 90, 100, 125, 150, 175, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more residues, or over the full length of the polypeptide, and the sequence identities are determined by analysis with a sequence comparison algorithm or by a visual inspection. Exemplary polypeptide or peptide sequences of the invention include SEQ ID NO:2, SEQ ID NO:4, SEQ ID NO:6, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:190, SEQ ID NO:192, SEQ ID NO:194, SEQ ID NO:204, SEQ ID NO:206, SEQ ID NO:208, SEQ ID NO:210, SEQ ID NO:212, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:461, SEQ ID NO:463, SEQ ID NO:464, SEQ ID NO:466, SEQ ID NO:468, SEQ ID NO:469, SEQ ID NO:470, SEQ ID NO:471, SEQ ID NO:472, SEQ ID NO:474, SEQ ID NO:476, SEQ ID NO:477, SEQ ID NO:479, SEQ ID NO:481, SEQ ID NO:482, SEQ ID NO:483, SEQ ID NO:485, SEQ ID NO:487, SEQ ID NO:488, SEQ ID NO:489, SEQ ID NO:490, SEQ ID NO:491, SEQ ID NO:493, SEQ ID NO:495, SEQ ID NO:496, SEQ ID NO:497, SEQ ID NO:499, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:510, SEQ ID NO:512, SEQ ID NO:513, SEQ ID NO:514, SEQ ID NO:516, SEQ ID NO:518, SEQ ID NO:518, SEQ ID NO:520, SEQ ID NO:521, SEQ ID NO:523, SEQ ID NO:525, SEQ ID NO:526, SEQ ID NO:528, SEQ ID NO:530, SEQ ID NO:531, SEQ ID NO:533, SEQ ID NO:535, SEQ ID NO:536, SEQ ID NO:537, SEQ ID NO:538, SEQ ID NO:540, SEQ ID NO:542, SEQ ID NO:543, SEQ ID NO:545, SEQ ID NO:547, SEQ ID NO:548, SEQ ID NO:549, SEQ ID NO:550, SEQ ID NO:551, SEQ ID NO:553, SEQ ID NO:555, SEQ ID NO:556, SEQ ID NO:557, SEQ ID NO:559, SEQ ID NO:561, SEQ ID NO:562, SEQ ID NO:563, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:589, SEQ ID NO:590, SEQ ID NO:591, SEQ ID NO:592, SEQ ID NO:594, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620 or SEQ ID NO:622, and subsequences thereof and variants thereof, e.g., at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500 or more residues in length, or over the full length of an enzyme. Exemplary polypeptide or peptide sequences of the invention include sequence encoded by a nucleic acid of the invention. Exemplary polypeptide or peptide sequences of the invention include polypeptides or peptides specifically bound by an antibody of the invention. In one aspect, a polypeptide of the invention has at least one amylase activity, e.g., an alpha amylase activity.

Another aspect of the invention is an isolated or recombinant polypeptide or peptide including at least 10 consecutive bases of a polypeptide or peptide sequence of the invention, sequences substantially identical thereto, and the sequences complementary thereto.

In one aspect, the amylase activity of a polypeptide or peptide of the invention comprises an a-amylase activity, including the ability to hydrolyze internal alpha-1,4-glucosidic linkages in starch to produce smaller molecular weight malto-dextrins. In one aspect, the a-amylase activity includes hydrolyzing internal alpha-1,4-glucosidic linkages in starch at random. The amylase activity can comprise a glucoamylase activity, a 1,4-a-D-glucan glucohydrolase activity, an a-amylase activity, an exoamylase activity, or a β-amylase activity. The amylase activity can comprise hydrolyzing glucosidic bonds. In one aspect, the glucosidic bonds comprise an a-1,4-glucosidic bond. In another aspect, the glucosidic bonds comprise an a-1,6-glucosidic bond. In one aspect, the amylase activity comprises hydrolyzing glucosidic bonds in starch, e.g., liquefied starch. The amylase activity can further comprise hydrolyzing glucosidic bonds into maltodextrins. In one aspect, the amylase activity comprises cleaving a maltose or a D-glucose unit from non-reducing end of the starch.

In one aspect, the amylase activity of the invention comprises a glucoamylase activity, which can comprise catalysis of the hydrolysis of glucosidic bonds. The glucoamylase activity of the invention can comprise catalyzing the stepwise hydrolytic release of D-glucose from the non-reducing ends of starch or other related dextrins. The glucoamylase activity can comprise a 1,4-a-D-glucan glucohydralase activity. The glucoamylase activity can comprise catalysis of the hydrolysis of malto-dextrins resulting in the generation of free glucose. The glucoamylase activity can comprise an exoamylase activity. The glucoamylase activity can comprise an a-amylase or a β-amylase activity. The hydrolyzed glucosidic bonds can comprise a-1,4-glucosidic bonds or a-1,6-glucosidic bonds. The glucoamylase activity can comprise hydrolyzing glucosidic bonds in a starch. The glucoamylase activity can further comprise hydrolyzing glucosidic bonds in the starch to produce maltodextrines. The glucoamylase activity can comprise cleaving a maltose or a D-glucose unit from non-reducing end of the starch.

In one aspect, the amylase activity can be thermostable. The polypeptide can retain an amylase activity under conditions comprising a temperature range of between about 37° C. to about 95° C., between about 55° C. to about 85° C., between about 70° C. to about 95° C., or between about 90° C. to about 95° C. In another aspect, the amylase activity can be thermotolerant. The polypeptide can retain an amylase activity after exposure to a temperature in the range from greater than 37° C. to about 95° C., or in the range from greater than 55° C. to about 85° C. In one aspect, the polypeptide can retain an amylase activity after exposure to a temperature in the range from greater than 90° C. to about 95° C. at pH 4.5.

In one aspect, the isolated or recombinant polypeptide can comprise the polypeptide of the invention that lacks a signal sequence. In one aspect, the isolated or recombinant polypeptide can comprise the polypeptide of the invention comprising a heterologous signal sequence, such as a heterologous amylase or non-amylase signal sequence.

In one aspect, the invention provides a signal sequence comprising a peptide as set forth in Table 3. In one aspect, the invention provides a signal sequence consisting of a peptide as set forth in Table 3. In one aspect, the invention provides chimeric proteins comprising a first domain comprising a signal sequence of the invention and at least a second domain. The protein can be a fusion protein. The second domain can comprise an enzyme. The enzyme can be an amylase (e.g., an amylase of the invention, or, another amylase).

In one aspect, the amylase activity comprises a specific activity at about 37° C. in the range from about 10 to 10,000, or, 100 to about 1000 units per milligram of protein. In another aspect, the amylase activity comprises a specific activity from about 500 to about 750 units per milligram of protein. Alternatively, the amylase activity comprises a specific activity at 37° C. in the range from about 500 to about 1200 units per milligram of protein. In one aspect, the amylase activity comprises a specific activity at 37° C. in the range from about 750 to about 1000 units per milligram of protein. In another aspect, the thermotolerance comprises retention of at least half of the specific activity of the amylase at 37° C. after being heated to the elevated temperature. Alternatively, the thermotolerance can comprise retention of specific activity at 37° C. in the range from about 500 to about 1200 units per milligram of protein after being heated to the elevated temperature.

The invention provides isolated or recombinant polypeptides of the invention, wherein the polypeptide comprises at least one glycosylation site. In one aspect, glycosylation can be an N-linked glycosylation. In one aspect, the polypeptide can be glycosylated after being expressed in a *P. pastoris* or a *S. pombe*. The invention also provides methods for adding glycosylation to a polypeptide, either post-translationally or chemically, to change the property of the polypeptides, e.g., its thermal stability, solubility, tendency to aggregate, and the like.

In one aspect, the polypeptide can retain an amylase activity under conditions comprising about pH 6.5, pH 6, pH 5.5, pH 5, pH 4.5 or pH 4. In another aspect, the polypeptide can retain an amylase activity under conditions comprising about pH 7, pH 7.5 pH 8.0, pH 8.5, pH 9, pH 9.5, pH 10, pH 10.5 or pH 11.

The invention provides protein preparations comprising a polypeptide of the invention, wherein the protein preparation comprises a liquid, a solid or a gel.

The invention provides heterodimers comprising a polypeptide of the invention and a second domain. In one aspect, the second domain can be a polypeptide and the heterodimer can be a fusion protein. In one aspect, the second domain can be an epitope or a tag. In one aspect, the invention provides homodimers comprising a polypeptide of the invention.

The invention provides immobilized polypeptides having an amylase activity, wherein the polypeptide comprises a polypeptide of the invention, a polypeptide encoded by a nucleic acid of the invention, or a polypeptide comprising a polypeptide of the invention and a second domain. In one aspect, the polypeptide can be immobilized on a cell, a metal, a resin, a polymer, a ceramic, a glass, a microelectrode, a graphitic particle, a bead, a gel, a plate, an array or a capillary tube.

The invention provides arrays comprising an immobilized nucleic acid of the invention. The invention provides arrays comprising an antibody of the invention.

The invention provides isolated or recombinant antibodies that specifically bind to a polypeptide of the invention or to a polypeptide encoded by a nucleic acid of the invention. The antibody can be a monoclonal or a polyclonal antibody. The invention provides hybridomas comprising an antibody of the invention, e.g., an antibody that specifically binds to a polypeptide of the invention or to a polypeptide encoded by a nucleic acid of the invention.

The invention provides food supplements for an animal comprising a polypeptide of the invention, e.g., a polypeptide encoded by the nucleic acid of the invention. In one aspect, the polypeptide in the food supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the amylase activity is thermotolerant. In another aspect, the amylase activity is thermostable.

The invention provides method of isolating or identifying a polypeptide having an amylase activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having an amylase activity.

The invention provides methods of making an anti-amylase antibody comprising administering to a non-human animal a nucleic acid of the invention or a polypeptide of the invention or subsequences thereof in an amount sufficient to generate a humoral immune response, thereby making an anti-amylase antibody. The invention is provides methods of making an anti-amylase immune comprising administering to a non-human animal a nucleic acid of the invention or a polypeptide of the invention or subsequences thereof in an amount sufficient to generate an immune response.

The invention provides methods of producing a recombinant polypeptide comprising the steps of: (a) providing a nucleic acid of the invention operably linked to a promoter; and (b) expressing the nucleic acid of step (a) under conditions that allow expression of the polypeptide, thereby producing a recombinant polypeptide. In one aspect, the method can further comprise transforming a host cell with the nucleic acid of step (a) followed by expressing the nucleic acid of step (a), thereby producing a recombinant polypeptide in a transformed cell.

The invention provides methods for identifying a polypeptide having an amylase activity comprising the following steps: (a) providing a polypeptide of the invention; or a polypeptide encoded by a nucleic acid of the invention; (b) providing an amylase substrate; and (c) contacting the polypeptide or a fragment or variant thereof of step (a) with the substrate of step (b) and detecting a decrease in the amount of substrate or an increase in the amount of a reaction product, wherein a decrease in the amount of the substrate or an increase in the amount of the reaction product detects a polypeptide having an amylase activity. In one aspect, the substrate can be a starch, e.g., a liquefied starch.

The invention provides methods for identifying an amylase substrate comprising the following steps: (a) providing a polypeptide of the invention; or a polypeptide encoded by a nucleic acid of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as an amylase substrate.

The invention provides methods of determining whether a test compound specifically binds to a polypeptide comprising the following steps: (a) expressing a nucleic acid or a vector comprising the nucleic acid under conditions permissive for translation of the nucleic acid to a polypeptide, wherein the nucleic acid comprises a nucleic acid of the invention, or, providing a polypeptide of the invention; (b) providing a test compound; (c) contacting the polypeptide with the test compound; and (d) determining whether the test compound of step (b) specifically binds to the polypeptide.

The invention provides methods for identifying a modulator of an amylase activity comprising the following steps: (a) providing a polypeptide of the invention or a polypeptide encoded by a nucleic acid of the invention; (b) providing a test compound; (c) contacting the polypeptide of step (a) with the test compound of step (b) and measuring an activity of the amylase, wherein a change in the amylase activity measured in the presence of the test compound compared to the activity in the absence of the test compound provides a determination that the test compound modulates the amylase activity. In one aspect, the amylase activity can be measured by providing an amylase substrate and detecting a decrease in the amount of the substrate or an increase in the amount of a reaction product, or, an increase in the amount of the substrate or a decrease in the amount of a reaction product. A decrease in the amount of the substrate or an increase in the amount of the reaction product with the test compound as compared to the amount of substrate or reaction product without the test compound identifies the test compound as an activator of amylase activity. An increase in the amount of the substrate or a decrease in the amount of the reaction product with the test compound as compared to the amount of substrate or reaction product without the test compound identifies the test compound as an inhibitor of amylase activity.

The invention provides computer systems comprising a processor and a data storage device wherein said data storage device has stored thereon a polypeptide sequence or a nucleic acid sequence of the invention (e.g., a polypeptide encoded by a nucleic acid of the invention). In one aspect, the computer system can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having an amylase activity from an environmental sample comprising the steps of: (a) providing an amplification primer sequence pair for amplifying a nucleic acid encoding a polypeptide having an amylase activity, wherein the primer pair is capable of amplifying a nucleic acid of the invention; (b) isolating a nucleic acid from the environmental sample or treating the environmental sample such that nucleic acid in the sample is accessible for hybridization to the amplification primer pair; and, (c) combining the nucleic acid of step (b) with the amplification primer pair of step (a) and amplifying nucleic acid from the environmental sample, thereby isolating or recovering a nucleic acid encoding a polypeptide having an amylase activity from an environmental sample. One or each member of the amplification primer sequence pair can comprise an oligonucleotide comprising at least about 10 to 50 consecutive bases of a sequence of the invention.

The invention provides methods for isolating or recovering a nucleic acid encoding a polypeptide having an amylase activity from an environmental sample comprising the steps of: (a) providing a polynucleotide probe comprising a nucleic acid of the invention or a subsequence thereof; (b) isolating a nucleic acid from the environmental sample or treating the environmental sample such that nucleic acid in the sample is accessible for hybridization to a polynucleotide probe of step (a); (c) combining the isolated nucleic acid or the treated environmental sample of step (b) with the polynucleotide probe of step (a); and (d) isolating a nucleic acid that specifically hybridizes with the polynucleotide probe of step (a), thereby isolating or recovering a nucleic acid encoding a polypeptide having an amylase activity from an environmental sample. The environmental sample can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having an amylase activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant amylase polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until an amylase having an altered or different activity or an altered or different stability from that of a polypeptide encoded by the template nucleic acid is produced. In one aspect, the variant amylase polypeptide is thermotolerant, and retains some activity after being exposed to an elevated temperature. In another aspect, the variant amylase polypeptide has increased glycosylation as compared to the amylase encoded by a template nucleic acid. Alternatively, the variant amylase polypeptide has an amylase activity under a high temperature, wherein the amylase encoded by the template nucleic acid is not active under the high temperature. In one aspect, the method can be iteratively repeated until an amylase coding sequence having an altered codon usage from that of the template nucleic acid is produced. In another aspect, the method can be iteratively repeated until an amylase gene having higher or lower level of message expression or stability from that of the template nucleic acid is produced.

The invention provides methods for modifying codons in a nucleic acid encoding a polypeptide having an amylase activity to increase its expression in a host cell, the method comprising the following steps: (a) providing a nucleic acid of the invention encoding a polypeptide having an amylase activity; and, (b) identifying a non-preferred or a less preferred codon in the nucleic acid of step (a) and replacing it with a preferred or neutrally used codon encoding the same amino acid as the replaced codon, wherein a preferred codon is a codon overrepresented in coding sequences in genes in the host cell and a non-preferred or less preferred codon is a codon underrepresented in coding sequences in genes in the host cell, thereby modifying the nucleic acid to increase its expression in a host cell.

The invention provides methods for modifying codons in a nucleic acid encoding a polypeptide having an amylase activity; the method comprising the following steps: (a) providing a nucleic acid of the invention; and, (b) identifying a codon in the nucleic acid of step (a) and replacing it with a different codon encoding the same amino acid as the replaced codon, thereby modifying codons in a nucleic acid encoding an amylase.

The invention provides methods for modifying codons in a nucleic acid encoding a polypeptide having an amylase activity to increase its expression in a host cell, the method comprising the following steps: (a) providing a nucleic acid of the invention encoding an amylase polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having an amylase activity to decrease its expression in a host cell, the method comprising the following steps: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified amylase active sites or substrate binding sites, wherein the modified active sites or substrate binding sites are derived from a first nucleic acid comprising a sequence encoding a first active site or a first substrate binding site the method comprising the following steps: (a) providing a first nucleic acid encoding a first active site or first substrate binding site, wherein the first nucleic acid sequence comprises a sequence that hybridizes under stringent conditions to a nucleic acid of the invention, and the nucleic acid encodes an amylase active site or an amylase substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified amylase active sites or substrate binding sites. In one aspect, the method comprises mutagenizing the first nucleic acid of step (a) by a method comprising an optimized directed evolution system, gene site-saturation mutagenesis (GSSM), synthetic ligation reassembly (SLR), error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR) and a combination thereof. In another aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising the following steps: (a) providing a plurality of biosynthetic enzymes capable of synthesizing or modifying a small molecule, wherein one of the enzymes comprises an amylase enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising the following steps: (a) providing an amylase enzyme, wherein the enzyme comprises a polypeptide of the invention, or, a polypeptide encoded by a nucleic acid of the invention, or a subsequence thereof; (b) providing a small molecule; and (c) reacting the enzyme of step (a) with the small molecule of step (b) under conditions that facilitate an enzymatic reaction catalyzed by the amylase enzyme, thereby modifying a small molecule by an amylase enzymatic reaction. In one aspect, the method can comprise a plurality of small molecule substrates for the enzyme of step (a), thereby generating a library of modified small molecules produced by at least one enzymatic reaction catalyzed by the amylase enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule which exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of an amylase enzyme comprising the steps of: (a) providing an amylase enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for an amylase activity, thereby determining a functional fragment of an amylase enzyme. In one aspect, the amylase activity is measured by providing an amylase substrate and detecting a decrease in the amount of the substrate or an increase in the amount of a reaction product.

The invention provides methods for whole cell engineering of new or modified phenotypes by using real-time metabolic flux analysis, the method comprising the following steps: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides methods for hydrolyzing a starch comprising the following steps: (a) providing a polypeptide having an amylase activity, wherein the polypeptide comprises a polypeptide of the invention; (b) providing a composition comprising a starch; and (c) contacting the polypeptide of step (a) with the composition of step (b) under conditions wherein the polypeptide hydrolyzes the starch. In one aspect, the composition comprising starch that comprises an a-1,4-glucosidic bond or an a-1,6-glucosidic bond. In one aspect, the amylase activity is an a-amylase activity. In one aspect, the a-amylase activity hydrolyzes internal bonds in a starch or other polysaccharide.

The invention provides methods for liquefying or removing a starch from a composition comprising the following steps: (a) providing a polypeptide having an amylase activity, wherein the polypeptide comprises a polypeptide of the invention; (b) providing a composition comprising a starch; and (c) contacting the polypeptide of step (a) with the composition of step (b) under conditions wherein the polypeptide removes or liquefies the starch.

The invention provides methods of increasing thermotolerance or thermostability of an amylase polypeptide, the method comprising glycosylating an amylase polypeptide, wherein the polypeptide comprises at least thirty contiguous amino acids of a polypeptide of the invention; or a polypeptide encoded by a nucleic acid sequence of the invention, thereby increasing the thermotolerance or thermostability of the amylase polypeptide. In one aspect, the amylase specific activity can be thermostable or thermotolerant at a temperature in the range from greater than about 37° C. to about 95° C.

The invention provides methods for overexpressing a recombinant amylase polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides detergent compositions comprising a polypeptide of the invention or a polypeptide encoded by a nucleic acid of the invention, wherein the polypeptide comprises an amylase activity. In one aspect, the amylase can be a nonsurface-active amylase. In another aspect, the amylase can be a surface-active amylase.

The invention provides methods for washing an object comprising the following steps: (a) providing a composition comprising a polypeptide having an amylase activity, wherein the polypeptide comprises: a polypeptide of the invention or a polypeptide encoded by a nucleic acid of the invention; (b) providing an object; and (c) contacting the polypeptide of step (a) and the object of step (b) under conditions wherein the composition can wash the object.

The invention provides methods for hydrolyzing starch, e.g., in a feed or a food prior to consumption by an animal, comprising the following steps: (a) obtaining a composition, e.g., a feed material, comprising a starch, wherein the polypeptide comprises: a polypeptide of the invention or a polypeptide encoded by a nucleic acid of the invention; and (b) adding the polypeptide of step (a) to the composition, e.g., the feed or food material, in an amount sufficient for a sufficient time period to cause hydrolysis of the starch, thereby hydrolyzing the starch. In one aspect, the food or feed comprises rice, corn, barley, wheat, legumes, or potato.

The invention provides methods for textile desizing comprising the following steps: (a) providing a polypeptide having an amylase activity, wherein the polypeptide comprises a polypeptide of the invention or a polypeptide encoded by a nucleic acid of the invention; (b) providing a fabric; and (c) contacting the polypeptide of step (a) and the fabric of step (b) under conditions wherein the amylase can desize the fabric.

The invention provides methods for deinking of paper or fibers comprising the following steps: (a) providing a polypeptide having an amylase activity, wherein the polypeptide comprises a polypeptide of the invention; (b) providing a composition comprising paper or fiber; and (c) contacting the polypeptide of step (a) and the composition of step (b) under conditions wherein the polypeptide can deink the paper or fiber.

The invention provides methods for treatment of lignocellulosic fibers comprising the following steps: (a) providing a polypeptide having an amylase activity, wherein the polypeptide comprises a polypeptide of the invention; (b) providing a lignocellulosic fiber; and (c) contacting the polypeptide of step (a) and the fiber of step (b) under conditions wherein the polypeptide can treat the fiber thereby improving the fiber properties.

The invention provides methods for producing a high-maltose or a high-glucose syrup comprising the following steps: (a) providing a polypeptide having an amylase activity, wherein the polypeptide comprises an enzyme of the invention; (b) providing a composition comprising a starch; and (c) contacting the polypeptide of step (a) and the fabric of step (b) under conditions wherein the polypeptide of step (a) can liquefy the composition of step (b) thereby producing a soluble starch hydrolysate and saccharify the soluble starch hydrolysate thereby producing the syrup. In one aspect, the starch can be from rice, corn, barley, wheat, legumes, potato, or sweet potato.

The invention provides methods for improving the flow of the starch-containing production fluids comprising the following steps: (a) providing a polypeptide having an amylase activity, wherein the polypeptide comprises a polypeptide of the invention; (b) providing production fluid; and (c) contacting the polypeptide of step (a) and the production fluid of step (b) under conditions wherein the amylase can hydrolyze the starch in the production fluid thereby improving its flow by decreasing its density. In one aspect, the production fluid can be from a subterranean formation.

The invention provides anti-staling compositions comprising a polypeptide of the invention or a polypeptide encoded by a nucleic acid of the invention. The invention provides methods for preventing staling of the baked products comprising the following steps: (a) providing a polypeptide having an amylase activity, wherein the polypeptide comprises a polypeptide of the invention; (b) providing a composition containing starch used for baking; (c) combining the polypeptide of step (a) with the composition of the step (b) under conditions wherein the polypeptide can hydrolyze the starch in the composition used for baking thereby preventing staling of the baked product. In one aspect, the baked product can be bread.

The invention provides methods for using amylase in brewing or alcohol production comprising the following steps: (a) providing a polypeptide having an amylase activity, wherein the polypeptide comprises a polypeptide of the invention; (b) providing a composition containing starch and used for brewing or in alcohol production; (c) combining the polypeptide of step (a) with the composition of the step (b) under conditions wherein the polypeptide can hydrolyze the starch in the composition used for brewing or in alcohol production. In one aspect, the composition containing starch can be beer.

The invention provides methods of making a transgenic plant comprising the following steps: (a) introducing a heterologous nucleic acid sequence into the cell, wherein the heterologous nucleic acid sequence comprises a nucleic acid sequence of the invention, thereby producing a transformed plant cell; and (b) producing a transgenic plant from the transformed cell. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an Agrobacterium tumefaciens host. In one aspect, the plant cell can be a potato, corn, rice, wheat, tobacco, or barley cell.

The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell.

The invention also provides a process for preparing a dough or a baked product prepared from the dough which comprises adding an amylase of the invention to the dough in an amount which is effective to retard the staling of the bread. The invention also provides a dough comprising said amylase and a premix comprising flour together with said amylase. Finally, the invention provides an enzymatic baking additive, which contains said amylase. The use of the amylase in accordance with the present invention provides an improved anti-staling effect as measured by, e.g. less crumb firming, retained crumb elasticity, improved slice-ability (e.g. fewer crumbs, non-gummy crumb), improved palatability or flavor.

The invention provides delayed release ("controlled release") compositions comprising an desired ingredient coated by a latex polymer (or equivalent) coating. In one aspect, the desired ingredient comprises an enzyme, e.g., an enzyme of the invention. In one aspect, the desired ingredient comprises a small molecule, a drug, a polysaccharide, a lipid, a nucleic acid, a vitamin, an antibiotics or an insecticide. In one aspect, the desired ingredient comprises a pellet or a matrix, e.g., a pellet or a matrix comprising an edible material (e.g., an animal food or feed or supplement or medicament). The invention also provides methods for the "controlled release" or "delayed release" of a composition, wherein the composition is coated by a latex polymer (or equivalent) coating.

In one aspect, the latex polymer coating comprises a latex paint, or equivalent. The latex polymer coating can comprise a (meth)acrylate, a vinyl acetate, a styrene, an ethylene, a vinyl chloride, a butadiene, a vinylidene chloride, a vinyl versatate, a vinyl propionate, a t-butyl acrylate, an acrylonitrile, a neoprene, a maleate, a fumarate, equivalents thereof, combinations thereof and/or derivatives thereof.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

DESCRIPTION OF DRAWINGS

FIG. 9 is a graph of the pH and temperature data for a selection of the amylases characterized.

FIG. 10 sets forth the sequences to be used in reassembly experiments with the enzymes.

FIG. 14 shows the sequence alignments of hypothermophilic α-amylases, as set forth in Example 8. FIG. 14a shows an alignment of amylase sequences. SEQ ID NO.: 81=an environmental clone; pyro=*Pyrococcus* sp. (strain:KOD1), Tachibana (1996) J. Ferment. Bioeng. 82:224-232; pyro2 =*Pyrococcus furiosus*, Appl. Environ. Microbiol. 63 (9):3569-3576, 1997; Thermo=*Thermococcus* sp.; Thermo2 =*Thermococcus hydrothermalis*, Leveque, E. et al. Patent: France 98.05655 5-May-1998. FIG. 14b shows the amino acid sequence alignment of identified sequences: SEQ ID NO.: 81; pyro; SEQ ID NO.:75; SEQ ID NO.: 77; SEQ ID NO.: 83; 25 SEQ ID NO.: 85; thermo2; SEQ ID NO.: 79; thermo; pyro2; clone A; thermo3. FIG. 14c shows the nucleic acid sequence alignment corresponding to the polypeptide sequence of FIGS. 5 and 6. SEQ ID NO.: 81; SEQ ID NO.:75; SEQ ID NO.: 77; SEQ ID NO.: 83; SEQ ID NO.: 85; SEQ ID NO.: 79; clone A; and SEQ ID NO.: 73.

FIG. 16 shows sequences of exemplary sequences of the invention.

FIG. 18 illustrates Table 7, which lists the relative percent identities of exemplary sequences of the invention, as described in Example 8, below.

FIG. 29 shows data summarizing these findings comparing amylase SEQ ID NO:437 with TERMAMYL™ SC (Novozymes A/S, Denmark) amylase in dry mill ethanol processing, as described in Example 1, below.

FIG. 34 illustrates an exemplary glucoamylase-encoding nucleic acid of the invention, the genomic sequence set forth in SEQ ID NO:587. Coding sequences (exons) are denoted with the single-letter amino acid below it. Intron sequences are underlined.

FIG. 35 is a chart describing selected characteristics of exemplary nucleic acids and polypeptides of the invention, as described in further detail, below.

Like reference symbols in the various drawings indicate like elements.

DETAILED DESCRIPTION

Figure 1:
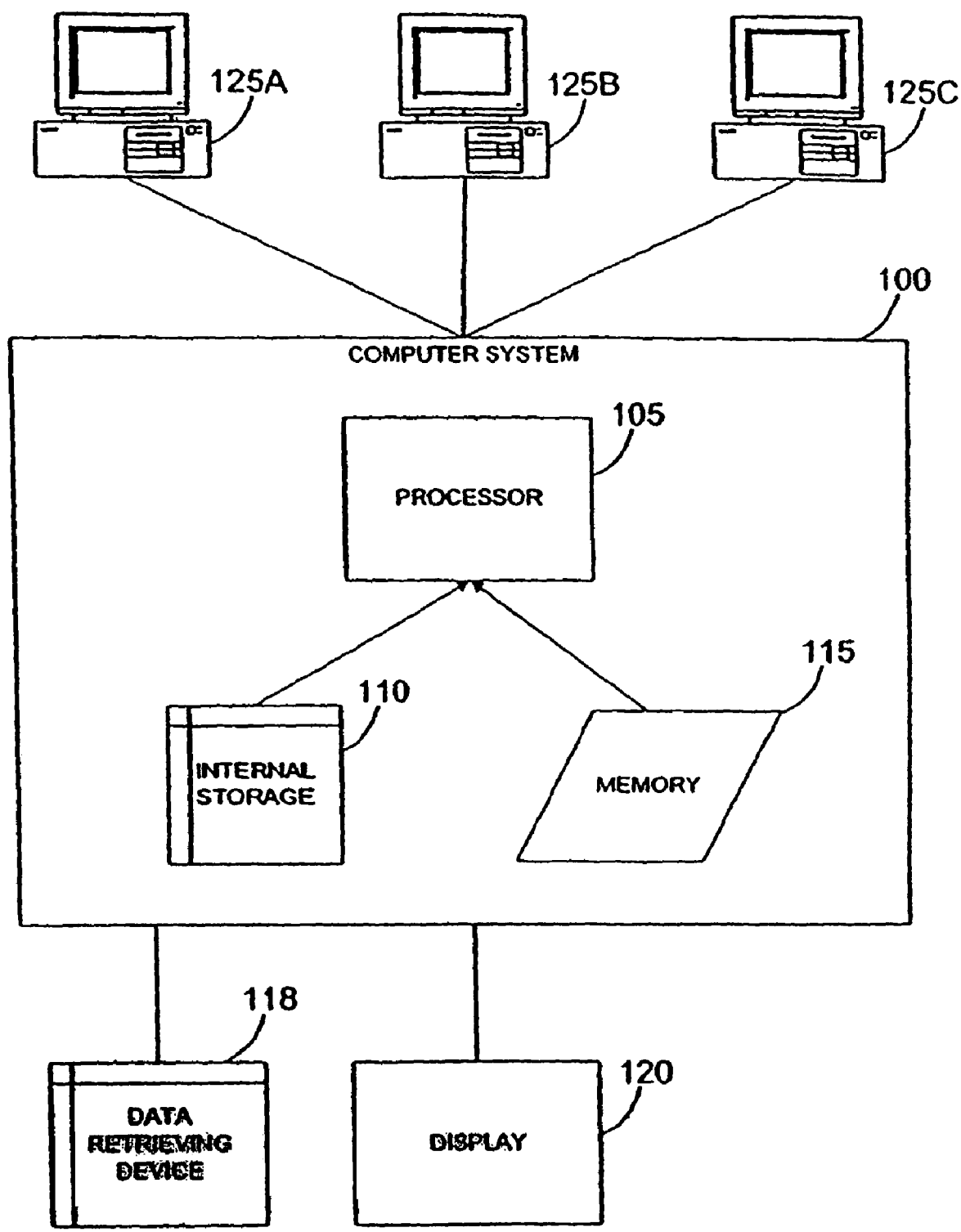
FIG. 1 is a block diagram of a computer system.

The invention provides amylase enzymes, e.g., an alpha amylases, polynucleotides encoding the enzymes, methods of making and using these polynucleotides and polypeptides. The invention is directed to novel polypeptides having an amylase activity, e.g., an alpha amylase activity, nucleic acids encoding them and antibodies that bind to them. The polypeptides of the invention can be used in a variety of diagnostic, therapeutic, and industrial contexts. The polypeptides of the invention can be used as, e.g., an additive for a detergent, for processing foods and for chemical synthesis utilizing a reverse reaction. Additionally, the polypeptides of the invention can be used in fabric treatment, alcohol production, and as additives to food or animal feed.

In one aspect, the amylases of the invention are active at a high and/or at a low temperature, or, over a wide range of temperature. For example, they can be active in the temperatures ranging between 20° C. to 90° C., between 30° C. to 80° C., or between 40°C. to 70° C. The invention also provides amylases that have activity at alkaline pHs or at acidic pHs, e.g., low water acidity. In alternative aspects, the amylases of the invention can have activity in acidic pHs as low as pH 5.0, pH 4.5, pH 4.0, and pH 3.5. In alternative aspects, the amylases of the invention can have activity in alkaline pHs as high as pH 9.5, pH 10, pH 10.5, and pH 11. In one aspect, the amylases of the invention are active in the temperature range of between about 40° C. to about 70° C. under conditions of low water activity (low water content).

The invention also provides methods for further modifying the exemplary amylases of the invention to generate proteins with desirable properties. For example, amylases generated by the methods of the invention can have altered enzymatic activity, thermal stability, pH/activity profile, pH/stability profile (such as increased stability at low, e.g. pH<6 or pH<5, or high, e.g. pH>9, pH values), stability towards oxidation, $Ca^{2+}$ dependency, specific activity and the like. The invention provides for altering any property of interest. For instance, the alteration may result in a variant which, as compared to a parent enzyme, has altered enzymatic activity, or, pH or temperature activity profiles.

Definitions

The term "amylase" includes all polypeptides, e.g., enzymes, which catalyze the hydrolysis of a polysaccharide, e.g., a starch. The term "amylase" includes polypeptides having an a-amylase activity, a β-amylase activity, a glucoamylase activity, a 1,4-a-D-glucan glucohydrolase activity, an exoamylase activity, a glucan a-maltotetrahydrolase activity, a maltase activity, an isomaltase activity, a glucan 1,4,a-glucosidase activity, an a-glucosidase activity, a sucrase activity or an agarase activity (e.g., a β-activity). For example, an amylase activity of the invention includes a-amylase activity, including the ability to hydrolyze internal alpha-1,4-glucosidic linkages in starch to produce smaller molecular weight malto-dextrins. In one aspect, the a-amylase activity includes hydrolyzing internal alpha-1,4-glucosidic linkages in starch at random. An amylase activity of the invention includes polypeptides having glucoamylase activity, such as the ability to hydrolase glucose polymers linked by a-1,4- and a-1,6-glucosidic bonds. In one aspect, the polypeptides of the invention have glucoamylase activity, hydrolyzing internal a-1,4-glucosidic linkages to yield smaller molecular weight malto-dextrins. An amylase activity of the invention also includes glucan 1,4-a-glucosidase activity, or, 1,4-a-D-glucan glucohydrolase, commonly called glucoamylase but also called amyloglucosidase and ?-amylase that, in one aspect, releases β-D-glucose from 1,4-a-, 1,6-a- and 1,3-a-linked glucans. An amylase activity of the invention also includes exo-amylase activity.

In one aspect, the glucoamylase activity comprises catalysis of the hydrolysis of glucosidic bonds. The glucoamylase activity can comprise catalyzing the step-wise hydrolytic release of D-glucose from the non-reducing ends of starch or other related dextrins. The glucoamylase activity can comprise a 1,4-a-D-glucan glucohydralase activity. The glucoamylase activity can comprise catalysis of the hydrolysis of malto-dextrins resulting in the generation of free glucose. The glucoamylase activity can comprise an exoamylase activity. The glucoamylase activity can comprise an a-amylase or a β-amylase activity. The hydrolyzed glucosidic bonds can comprise a-1,4-glucosidic bonds or a-1,6-glucosidic bonds. The glucoamylase activity can comprise hydrolyzing glucosidic bonds in a starch. The glucoamylase activity can further comprise hydrolyzing glucosidic bonds in the starch to produce maltodextrines. The glucomylase activity can comprise cleaving a maltose or a D-glucose unit from non-reducing end of the starch.

An amylase activity of the invention also includes hydrolyzing a polysaccharide, e.g., a starch, at high temperatures, low temperatures, alkaline pHs and at acidic pHs. For example, in one aspect, the invention provides polypeptides, and nucleic acids encoding them, having an amylase, e.g., a glucoamylase, activity which is thermostable. The polypeptide can retain an amylase activity under conditions comprising a temperature range of between about 37° C., to about 95° C.; between about 55° C. to about 85° C., between about 70° C. to about 95° C., or, between about 90° C. to about 95° C. In another aspect, a polypeptide of the invention can have a glucoamylase activity which is thermotolerant. The polypeptide can retain an amylase, e.g., a glucoamylase, activity after exposure to a temperature in the range from greater than 37° C. to about 95° C. or anywhere in the range from greater than 55° C. to about 85° C. In one aspect, the polypeptide retains an amylase activity after exposure to a temperature in the range from greater than 90° C. to about 95° C. at pH 4.5.

An "amylase variant" comprises an amino acid sequence which is derived from the amino acid sequence of a "precursor amylase". The precursor amylase can include naturally-occurring amylases and recombinant amylases. The amino acid sequence of the amylase variant can be "derived" from the precursor amylase amino acid sequence by the substitution, deletion or insertion of one or more amino acids of the precursor amino acid sequence. Such modification can be of the "precursor DNA sequence" which encodes the amino acid sequence of the precursor amylase rather than manipulation of the precursor amylase enzyme per se. Suitable methods for such manipulation of the precursor DNA sequence include methods disclosed herein, as well as methods known to those skilled in the art.

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody."

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

As used herein, the terms "computer," "computer program" and "processor" are used in their broadest general contexts and incorporate all such devices, as described in detail, below. A "coding sequence of" or a "sequence encodes" a particular polypeptide or protein, is a nucleic acid sequence which is transcribed and translated into a polypeptide or protein when placed under the control of appropriate regulatory sequences.

The term "expression cassette" as used herein refers to a nucleotide sequence which is capable of affecting expression of a structural gene (i.e., a protein coding sequence, such as an amylase of the invention) in a host compatible with such sequences. Expression cassettes include at least a promoter operably linked with the polypeptide coding sequence; and, optionally, with other sequences, e.g., transcription termination signals. Additional factors necessary or helpful in effecting expression may also be used, e.g., enhancers. Thus, expression cassettes also include plasmids, expression vectors, recombinant viruses, any form of recombinant "naked DNA" vector, and the like.

"Operably linked" as used herein refers to a functional relationship between two or more nucleic acid (e.g., DNA) segments. Typically, it refers to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

A "vector" comprises a nucleic acid which can infect, transfect, transiently or permanently transduce a cell. It will be recognized that a vector can be a naked nucleic acid, or a nucleic acid complexed with protein or lipid. The vector optionally comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

As used herein, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Tissue-specific" promoters are transcriptional control elements that are only active in particular cells or tissues or organs, e.g., in plants or animals. Tissue-specific regulation may be achieved by certain intrinsic factors which ensure that genes encoding proteins specific to a given tissue are expressed. Such factors are known to exist in mammals and plants so as to allow for specific tissues to develop.

The term "plant" includes whole plants, plant parts (e.g., leaves, stems, flowers, roots, etc.), plant protoplasts, seeds and plant cells and progeny of same. The class of plants which can be used in the method of the invention is generally as broad as the class of higher plants amenable to transformation techniques, including angiosperms (monocotyledonous and dicotyledonous plants), as well as gymnosperms. It includes plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes) of the invention.

"Plasmids" can be commercially available, publicly available on an unrestricted basis, or can be constructed from available plasmids in accord with published procedures. Equivalent plasmids to those described herein are known in the art and will be apparent to the ordinarily skilled artisan.

The term "gene" includes a nucleic acid sequence comprising a segment of DNA involved in producing a transcription product (e.g., a message), which in turn is translated to produce a polypeptide chain, or regulates gene transcription, reproduction or stability. Genes can include regions preceding and following the coding region, such as leader and trailer, promoters and enhancers, as well as, where applicable, intervening sequences (introns) between individual coding segments (exons).

The phrases "nucleic acid" or "nucleic acid sequence" includes oligonucleotide, nucleotide, polynucleotide, or to a fragment of any of these, to DNA or RNA (e.g., mRNA, rRNA, tRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156.

"Amino acid" or "amino acid sequence" include an oligopeptide, peptide, polypeptide, or protein sequence, or to a fragment, portion, or subunit of any of these, and to naturally occurring or synthetic molecules. The terms "polypeptide" and "protein" include amino acids joined to each other by peptide bonds or modified peptide bonds, i.e., peptide isosteres, and may contain modified amino acids other than the 20 gene-encoded amino acids. The term "polypeptide" also includes peptides and polypeptide fragments, motifs and the like. The term also includes glycosylated polypeptides. The peptides and polypeptides of the invention also include all "mimetic" and "peptidomimetic" forms, as described in further detail, below.

The term "isolated" includes a material removed from its original environment, e.g., the natural environment if it is naturally occurring. For example, a naturally occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment. As used herein, an isolated material or composition can also be a "purified" composition, i.e., it does not require absolute purity; rather, it is intended as a relative definition. Individual nucleic acids obtained from a library can be conventionally purified to electrophoretic homogeneity. In alternative aspects, the invention provides nucleic acids which have been purified from genomic DNA or from other sequences in a library or other environment by at least one, two, three, four, five or more orders of magnitude.

As used herein, the term "recombinant" can include nucleic acids adjacent to a "backbone" nucleic acid to which it is not adjacent in its natural environment. In one aspect, nucleic acids represent 5% or more of the number of nucleic acid inserts in a population of nucleic acid "backbone molecules." "Backbone molecules" according to the invention include nucleic acids such as expression vectors, self-replicating nucleic acids, viruses, integrating nucleic acids, and other vectors or nucleic acids used to maintain or manipulate a nucleic acid insert of interest. In one aspect, the enriched nucleic acids represent 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more of the number of nucleic acid inserts in the population of recombinant backbone molecules. "Recombinant" polypeptides or proteins refer to polypeptides or proteins produced by recombinant DNA techniques; e.g., produced from cells transformed by an exogenous DNA construct encoding the desired polypeptide or protein. "Synthetic" polypeptides or protein are those prepared by chemical synthesis, as described in further detail, below.

A promoter sequence can be "operably linked to" a coding sequence when RNA polymerase which initiates transcription at the promoter will transcribe the coding sequence into mRNA, as discussed further, below.

"Oligonucleotide" includes either a single stranded polydeoxynucleotide or two complementary polydeoxynucleotide strands which may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

The phrase "substantially identical" in the context of two nucleic acids or polypeptides, can refer to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one any known sequence comparison algorithm, as discussed in detail below, or by visual inspection. In alternative aspects, the invention provides nucleic acid and polypeptide sequences having substantial identity to an exemplary sequence of the invention over a region of at least about 10, 20, 30, 40, 50, 100, 150, 200, 250, 300, 350, 400, 450, 500, 550, 600, 650, 700, 750, 800, 850, 900, 950, 1000 or more residues, or a region ranging from between about 50 residues to the full length of the nucleic acid or polypeptide. Nucleic acid sequences of the invention can be substantially identical over the entire length of a polypeptide coding region.

A "substantially identical" amino acid sequence also can include a sequence that differs from a reference sequence by one or more conservative or non-conservative amino acid substitutions, deletions, or insertions, particularly when such a substitution occurs at a site that is not the active site of the molecule, and provided that the polypeptide essentially retains its functional properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from an amnylase, resulting in modification of the structure of the polypeptide, without significantly altering its biological activity. For example, amino- or carboxyl-terminal amino acids that are not required for amylase activity can be removed.

"Hybridization" includes the process by which a nucleic acid strand joins with a complementary strand through base pairing. Hybridization reactions can be sensitive and selective so that a particular sequence of interest can be identified even in samples in which it is present at low concentrations. Stringent conditions can be defined by, for example, the concentrations of salt or formamide in the prehybridization and hybridization solutions, or by the hybridization temperature, and are well known in the art. For example, stringency can be increased by reducing the concentration of salt, increasing the concentration of formamide, or raising the hybridization temperature, altering the time of hybridization, as described in detail, below. In alternative aspects, nucleic acids of the invention are defined by their ability to hybridize under various stringency conditions (e.g., high, medium, and low), as set forth herein.

"Variant" includes polynucleotides or polypeptides of the invention modified at one or more base pairs, codons, introns, exons, or amino acid residues (respectively) yet still retain the biological activity of an amylase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, GSSM and any combination thereof. Techniques for producing variant amylase having activity at a pH or temperature, for example, that is different from a wild-type amylase, are included herein.

The term "saturation mutagenesis" or "GSSM" includes a method that uses degenerate oligonucleotide primers to introduce point mutations into a polynucleotide, as described in detail, below.

The term "optimized directed evolution system" or "optimized directed evolution" includes a method for reassembling fragments of related nucleic acid sequences, e.g., related genes, and explained in detail, below.

The term "synthetic ligation reassembly" or "SLR" includes a method of ligating oligonucleotide fragments in a non-stochastic fashion, and explained in detail, below.

Generating and Manipulating Nucleic Acids

In one aspect, the invention provides isolated or recombinant nucleic acids comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%,-96%, 97%, 98%, 99%, or more, or complete (100%) sequence identity to an exemplary nucleic acid of the invention over a region of at least about 10, 15, 20, 25, 30, 35, 40, 45, 50, 55, 60, 65, 70, 75, 100, 150, 200, 250, 300, 350, 400, 450, 500, 550, 600, 650, 700, 750, 800, 850, 900, 950,. 1000,1050, 1100, 1150, 1200, 1250, 1300, 1350,1400, 1450,1500, 1550or more, residues. In one aspect, the nucleic acid encodes at least one polypeptide having an amylase activity, e.g., an alpha amylase activity.

For example, the following table describes some exemplary amylase-encoding nucleic acids of the invention, e.g., the invention provides an amylase having a sequence as set forth in SEQ ID NO:474, having an exemplary coding sequence as set forth in SEQ ID NO:473, and in one aspect is encoded by a gene, including introns and exons, having a sequence as set forth in SEQ ID NO:467 (including exons having sequences as set forth in SEQ ID NO:468, SEQ ID NO:469, SEQ ID NO:470, SEQ ID NO:471 and SEQ ID NO:472); etc.:

| Amyl-ase | SEQ ID NO: of full gene (exons and introns) | SEQ ID NOS: of exon sequences | SEQ ID NO: of DNA sequence of coding sequence (exons only) | SEQ ID NO: of protein sequence of coding sequence (exons only) | TOTAL |
|---|---|---|---|---|---|
| A | 460, 461 | N/A | 460 | 461 | 460, 461 |
| B | 462 | 463, 464 | 465 | 466 | 462-466 |
| C | 467 | 468-472 | 473 | 474 | 467-474 |
| D | 475 | 476-477 | 478 | 479 | 475-479 |
| E | 480 | 481-483 | 484 | 485 | 480-485 |
| F | 486 | 487-491 | 492 | 493 | 486-493 |

-continued

| Amylase | SEQ ID NO: of full gene (exons and introns) | SEQ ID NOS: of exon sequences | SEQ ID NO: of DNA sequence of coding sequence (exons only) | SEQ ID NO: of protein sequence of coding sequence (exons only) | TOTAL |
|---|---|---|---|---|---|
| G | 494 | 495-497 | 498 | 499 | 494-499 |
| H | 500 | 501-508 | 509 | 510 | 500-510 |
| I | 511 | 512-514 | 515 | 516 | 511-516 |
| J | 517, 518 | N/A | 517 | 518 | 517, 518 |
| K | 519 | 520-521 | 522 | 523 | 519-523 |
| L | 524 | 525-526 | 527 | 528 | 524-528 |
| M | 529 | 530-531 | 532 | 533 | 529-533 |
| N | 534 | 535-538 | 539 | 540 | 534-540 |
| O | 541 | 542-543 | 544 | 545 | 541-545 |
| P | 546 | 547-551 | 552 | 553 | 546-553 |
| Q | 554 | 555-557 | 558 | 559 | 554-559 |
| R | 560 | 561-564 | 565 | 566 | 560-566 |
| S | 587 | 588-592 | 593 | 594 | 587-594 |

The above listed amylases (described as A thru S) and the nucleic acids that encode them have a common novelty in that they were initially isolated/ derived from fungal sources.

The invention also provides glucoamylases, such as the enzyme having a sequence as set forth in SEQ ID NO:594 encoded by the 4111 residues of the genomic SEQ ID NO:587, or, the 1854 residue long cDNA of SEQ ID NO:593). The genomic SEQ ID NO:587, comprises introns and exons, and the exons can be described as encoding polypeptide fragments having a sequence as set forth in SEQ ID NO:588, SEQ ID NO:589, SEQ ID NO:590, SEQ ID NO:591, SEQ ID NO:592. In one aspect, the "mature" processed glucoamylase consisting of residues 32 to 617 of SEQ ID NO: 594.

The invention provides isolated and recombinant nucleic acids, including expression cassettes such as expression vectors encoding the polypeptides of the invention. The invention provides probes comprising or consisting of nucleic acids of the invention. The invention also includes methods for discovering new amylase sequences using the nucleic acids of the invention. The invention also includes methods for inhibiting the expression of amylase genes, transcripts and polypeptides using the nucleic acids of the invention. Also provided are methods for modifying the nucleic acids of the invention by, e.g., synthetic ligation reassembly, optimized directed evolution system and/or gene site saturation mutagenesis (GSSM™).

The nucleic acids of the invention can be made, isolated and/or manipulated by, e.g., cloning and expression of cDNA libraries, amplification of message or genomic DNA by PCR, and the like. In practicing the methods of the invention, homologous genes can be modified by manipulating a template nucleic acid, as described herein. The invention can be practiced in conjunction with any method or protocol or device known in the art, which are well described in the scientific and patent literature.

General Techniques

The nucleic acids used to practice this invention, whether RNA, iRNA, antisense nucleic acid, cDNA, genomic DNA, vectors, viruses or hybrids thereof, may be isolated from a variety of sources, genetically engineered, amplified, and/or expressed/ generated recombinantly. Recombinant polypeptides generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/ affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lac, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I.

Promoters suitable for expressing a polypeptide in bacteria include the *E. coli* lac or trp promoters, the lacI promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used.

Tissue-Specific Plant Promoters

The invention provides expression cassettes that can be expressed in a tissue-specific manner, e.g., that can express an amylase of the invention in a tissue-specific specific manner. The invention also provides plants or seeds that express an amylase of the invention in a tissue-specific manner. The tissue-specificity can be seed specific, stem specific, leaf specific, root specific, fruit specific and the like.

In one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill. Such genes include, e.g., ACT11 from *Arabidopsis* (Huang (1996) Plant Mol. Biol. 33:125-139); Cat3 from *Arabidopsis* (GenBank No. U43147, Zhong (1996) Mol. Gen. Genet. 251:196-203); the gene encoding stearoyl-acyl carrier protein desaturase from Brassica napus (Genbank No. X74782, Solocombe (1994) Plant Physiol. 104:1167-1176); GPc1 from maize (GenBank No. X15596; Martinez (1989) *J. Mol. Biol* 208:551-565); the Gpc2 from maize (GenBank No. U45855, Manjunath (1997) *Plant Mol. Biol.* 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro bacilliform virus (RTBV), which replicates only in phloem cells in infected rice plants, with its promoter which drives strong phloem-specific reporter gene expression; the cassava vein mosaic virus (CVMV) promoter, with highest activity in vascular elements, in leaf mesophyll cells, and in root tips (Verdaguer (1996) Plant Mol. Biol. 31:1129-1139).

Alternatively, the plant promoter may direct expression of amylase-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant Mol. Biol. 33:897 909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:367-77, describing the transcription factor SPL3, which recognizes a conserved sequence motif in the promoter region of the *A. thaliana* floral meristem identity gene AP1; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fb12A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficket (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean (*Glycine max L.*) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa L.* (oat) arginine decarboxylase gene (Masgrau (1997) Plant J. 11:465-473); or, a salicylic acid-responsive element (Stange (1997) Plant J. 11:1315-1324). Using chemically- (e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

One of skill will recognize that a tissue-specific plant promoter may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the amylase-producing nucleic acids of the invention will allow the grower to select plants with the optimal starch/sugar ratio. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa L.* (oat) arginine decarboxylase gene (Masgrau (1997) Plant J. 11:465-473); or, a salicylic acid-responsive element (Stange (1997) Plant J. 11:1315-1324).

If proper polypeptide expression is desired, a polyadenylation region at the 3'-end of the coding region should be included. The polyadenylation region can be derived from the natural gene, from a variety of other plant genes, or from genes in the *Agrobacterial* T-DNA.

Expression Vectors and Cloning Vehicles

The invention provides expression vectors and cloning vehicles comprising nucleic acids of the invention, e.g., sequences encoding the amylases of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as *bacillus, Aspergillus* and yeast). Vectors of the invention can include chromosomal, non-chromosomal and synthetic DNA sequences. Large numbers of suitable vectors are known to those of skill in the art, and are commercially available. Exemplary vectors are include: bacterial: pQE vectors (Qiagen), pBluescript plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRP 1 gene. Promoter regions can be selected from any desired gene using chloramphenicol transferase (CAT) vectors or other vectors with selectable markers.

Vectors for expressing the polypeptide or fragment thereof in eukaryotic cells can also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage.

Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), pKK223-3 (Pharmacia Fine Chemicals, Uppsala, Sweden), GEMI (Promega Biotec, Madison, Wis., USA) pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal minichromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from *Agrobacterium* spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234: 243-252), bean golden mosaic virus (see, e.g., Morinaga (1993) Microbiol Immunol. 37:471-476), cauliflower mosaic virus (see, e.g., Cecchini (1997) Mol. Plant Microbe Interact. 10:1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

Host Cells and Transformed Cells

The invention also provides a transformed cell comprising a nucleic acid sequence of the invention, e.g., a sequence encoding an amylase of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Exemplary bacterial cells include *E. coli*, any *Streptomyces* or *Bacillus* (e.g., *Bacillus cereus, Bacillus subtilis*), *Salmonella typhimurium* and various species within the genera *Bacillus, Streptomyces*, and *Staphylococcus*. Exemplary insect cells include *Drosophila* S2 and Spodoptera Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477, U.S. Pat. No. 5,750, 870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include $CaPO_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets are preferred.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host is cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed MRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in E. coli.

Amplification of Nucleic Acids

In practicing the invention, nucleic acids of the invention and nucleic acids encoding the polypeptides of the invention, or modified nucleic acids of the invention, an be reproduced by amplification. Amplification can also be used to clone or modify the nucleic acids of the invention. Thus, the invention provides amplification primer sequence pairs for amplifying nucleic acids of the invention. One of skill in the art can design amplification primer sequence pairs for any part of or the full length of these sequences.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Determining the Degree of Sequence Identity

The invention provides nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention. The extent of sequence identity (homology) may be determined using any computer program and associated parameters, including those described herein, such as BLAST 2.2.2. or FASTA version 3.0t78, with the default parameters.

Figure 35C:
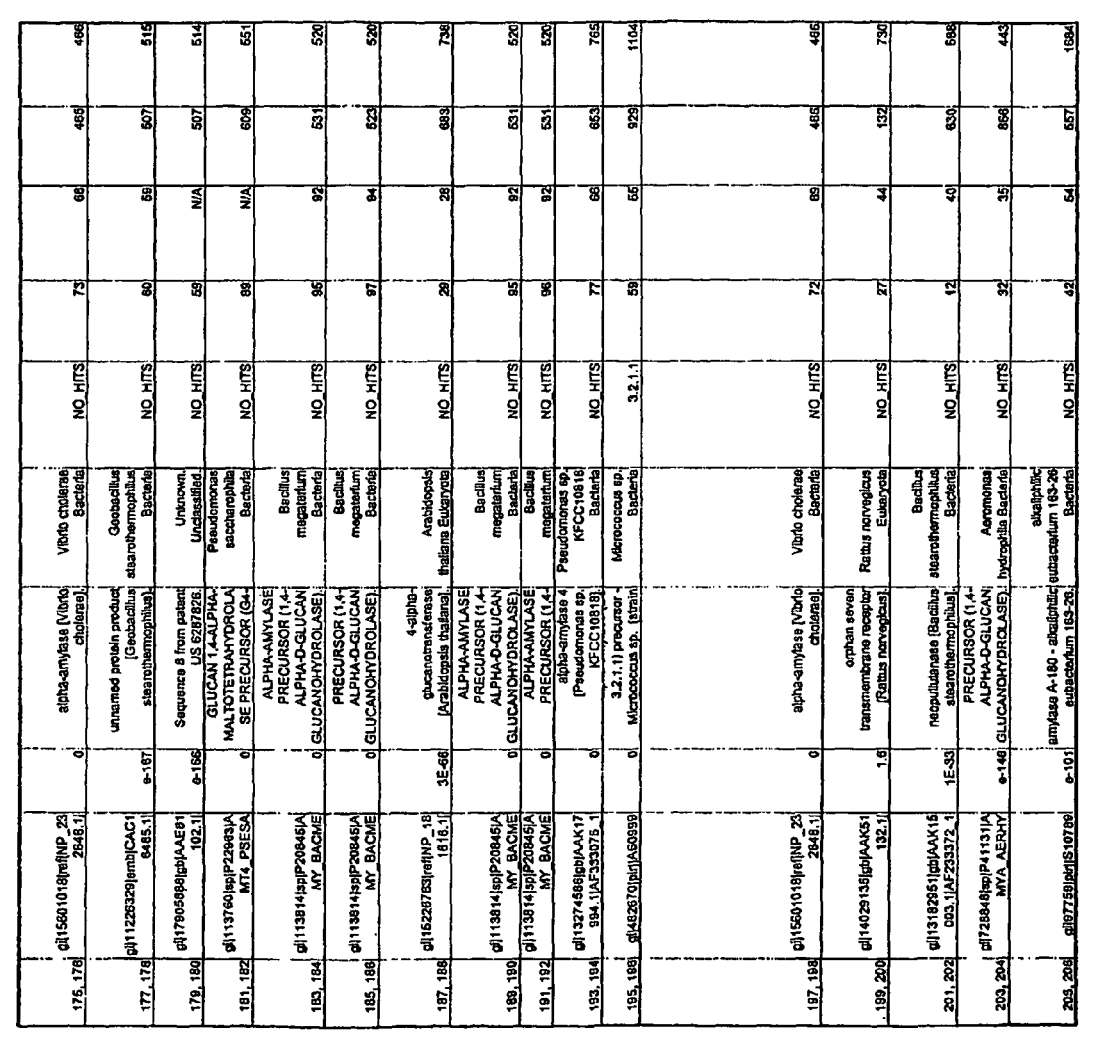

FIG. 35 is a chart describing selected characteristics of exemplary nucleic acids and polypeptides of the invention, including sequence identity comparison of the exemplary sequences to public databases. All sequences described in FIG. 35 have been subject to a BLAST search (as described in detail, below) against two sets of databases. The first database set is available through NCBI (National Center for Biotechnology Information). All results from searches against these databases are found in the columns entitled "NR Description", "NR Accession Code", "NR Evalue" or "NR Organism". "NR" refers to the Non-Redundant nucleotide database maintained by NCBI. This database is a composite of GenBank, GenBank updates, and EMBL updates. The entries in the column "NR Description" refer to the definition line in any given NCBI record, which includes a description of the sequence, such as the source organism, gene name/protein name, or some description of the function of the sequence. The entries in the column "NR Accession Code" refer to the unique identifier given to a sequence record. The entries in the column "NR Evalue" refer to the Expect value (Evalue), which represents the probability that an alignment score as good as the one found between the query sequence (the sequences of the invention) and a database sequence would be found in the same number of comparisons between random sequences as was done in the present BLAST search. The entries in the column "NR Organism" refer to the source organism of the sequence identified as the closest BLAST hit. The second set of databases is collectively known as the Genesemq™ database, which is available through Thomson Derwent (Philadelphia, Pa.). All results from searches against this database are found in the columns entitled "Geneseq Protein Description", "Geneseq Protein Accession Code", "Geneseq Protein Evalue", "Geneseq DNA Description", "Geneseq DNA Accession Code" or "Geneseq DNA Evalue". The information found in these columns is comparable to the information found in the NR columns described above, except that it was derived from BLAST searches against the Geneseq™ database instead of the NCBI databases. In addition, this table includes the column "Predicted EC No.". An EC number is the number assigned to a type of enzyme according to a scheme of standardized enzyme nomenclature developed by the Enzyme Commission of the Nomenclature Committee of the International Union of Biochemistry and Molecular Biology (IUBMB). The results in the "Predicted EC No." column are determined by a BLAST search against the Kegg (Kyoto Encyclopedia of Genes and Genomes) database. If the top BLAST match has an Evalue equal to or less than $e^{-6}$, the EC number assigned to the top match is entered into the table. The EC number of the top hit is used as a guide to what the EC number of the sequence of the invention might be. The columns "Query DNA Length" and "Query Protein Length" refer to the number of nucleotides or the number amino acids, respectively, in the sequence of the invention that was searched or queried against either the NCBI or Geneseq databases. The columns "Geneseq or NR DNA Length" and "Geneseq or NR Protein Length" refer to the number of nucleotides or the number amino acids, respectively, in the sequence of the top match from the BLAST search. The results provided in these columns are from the search that returned the lower Evalue, either from the NCBI databases or the Geneseq database. The columns "Geneseq or NR % ID Protein" and "Geneseq or NR % ID DNA" refer to the percent sequence identity between the sequence of the invention and the sequence of the top BLAST match. The results provided in these columns are from the search that returned the lower Evalue, either from the NCBI databases or the Geneseq database.

Homologous sequences also include RNA sequences in which uridines replace the thymines in the nucleic acid sequences. The homologous sequences may be obtained using any of the procedures described herein or may result from the correction of a sequencing error. It will be appreciated that the nucleic acid sequences as set forth herein can be represented in the traditional single character format (see, e.g., Stryer, Lubert. Biochemistry, 3rd Ed., W. H Freeman & Co., New York) or in any other format which records the identity of the nucleotides in a sequence.

Various sequence comparison programs identified herein are used in this aspect of the invention. Protein and/or nucleic acid sequence identities (homologies) may be evaluated using any of the variety of sequence comparison algorithms and programs known in the art. Such algorithms and programs include, but are not limited to, TBLASTN, BLASTP, FASTA, TFASTA, and CLUSTALW (Pearson and Lipman, Proc. Natl. Acad. Sci. USA 85(8):2444-2448, 1988; Altschul et al., J. Mol. Biol. 215(3):403-410, 1990; Thompson et al., Nucleic Acids Res. 22(2):4673-4680, 1994; Higgins et al., Methods Enzymol. 266:383-402, 1996; Altschul et al., J. Mol. Biol. 215(3):403-410, 1990; Altschul et al., Nature Genetics 3:266-272, 1993).

Homology or sequence identity can be measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection. For sequence comparison, one sequence can act as a reference sequence, e.g., a sequence of the invention, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the numbers of contiguous residues. For example, in alternative aspects of the invention, contiguous residues ranging anywhere from 20 to the full length of an exemplary polypeptide or nucleic acid sequence of the invention are compared to a reference sequence of the same number of contiguous positions after the two sequences are optimally aligned. If the reference sequence has the requisite sequence identity to an exemplary polypeptide or nucleic acid sequence of the invention, e.g., 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a sequence of the invention, that sequence is within the scope of the invention. In alternative embodiments, subsequences ranging from about 20 to 600, about 50 to 200, and about 100 to 150 are compared to a reference sequence of the same number of contiguous positions after the two sequences are optimally aligned.

Methods of alignment of sequence for comparison are well known in the art. In alternative aspects, optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol. 48:443, 1970, by the search for similarity method of person & Lipman, Proc. Nat'l. Acad. Sci. USA 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project (Gibbs, 1995). Several genomes have been sequenced, e.g., *M. genitalium* (Fraser et al., 1995), *M. jannaschii* (Bult et al., 1996), *H. influenzae* (Fleischimann et al., 1995), *E. coli* (Blattner et al., 1997), and yeast (*S. cerevisiae*) (Mewes et al., 1997), and *D. melanogaster* (Adams et al., 2000).

Significant progress has also been made in sequencing the genomes of model organism, such as mouse, *C. elegans*, and *Arabadopsis* sp. Databases containing genomic information annotated with some functional information are maintained by different organization, and are accessible via the internet.

BLAST, BLAST 2.0 and BLAST 2.2.2 algorithms also can be used to practice the invention. They are described, e.g., in Altschul (1977) Nuc. Acids Res. 25:3389-3402; Altschul (1990) J. Mol. Biol. 215:403-410. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul (1990) supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3, and expectations (E) of 10, and the BLOSUM62 scoring matrix (see Henikoff & Henikoff (1989) Proc. Natl. Acad. Sci. USA 89:10915) alignments (B) of 50, expectation (E) of 10, M=5, N=−4, and a comparison of both strands. The BLAST algorithm also performs a statistical analysis of the similarity between two sequences (see, e.g., Karlin & Altschul (1993) Proc. Natl. Acad. Sci. USA 90:5873). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01, and most preferably less than about 0.001. In one aspect, protein and nucleic acid sequence homologies are evaluated using the Basic Local Alignment Search Tool ("BLAST"). For example, five specific BLAST programs can be used to perform the following task: (1) BLASTP and BLAST3 compare an amino acid query sequence against a protein sequence database; (2) BLASTN compares a nucleotide query sequence against a nucleotide sequence database; (3) BLASTX compares the six-frame conceptual translation products of a query nucleotide sequence (both strands) against a protein sequence database; (4) TBLASTN compares a query protein sequence against a nucleotide sequence database translated in all six reading frames (both strands); and, (5) TBLASTX compares the six-frame translations of a nucleotide query sequence against the six-frame translations of a nucleotide sequence database. The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., Science 256:1443-1445, 1992; Henikoff and Henikoff, Proteins 17:49-61, 1993). Less preferably, the PAM or PAM250 matrices may also be used (see, e.g., Schwartz and Dayhoff, eds., 1978, Matrices for Detecting Distance Relationships: Atlas of Protein Sequence and Structure, Washington: National Biomedical Research Foundation).

In one aspect of the invention, to determine if a nucleic acid has the requisite sequence identity to be within the scope of the invention, the NCBI BLAST 2.2.2 programs is used, default options to blastp. There are about 38 setting options in the BLAST 2.2.2 program. In this exemplary aspect of the invention, all default values are used except for the default filtering setting (i.e., all parameters set to default except filtering which is set to OFF); in its place a "-F F" setting is used, which disables filtering. Use of default filtering often results in Karlin-Altschul violations due to short length of sequence.

The default values used in this exemplary aspect of the invention, and to determine the values in FIG. 35, as discussed above, include:

"Filter for low complexity: ON
Word Size: 3
Matrix: Blosum62
Gap Costs: Existence:11
Extension:1"

Other default settings can be: filter for low complexity OFF, word size of 3 for protein, BLOSUM62 matrix, gap existence penalty of −11 and a gap extension penalty of −1. An exemplary NCBI BLAST 2.2.2 program setting has the "-W" option default to 0. This means that, if not set, the word size defaults to 3 for proteins and 11 for nucleotides.

Computer Systems and Computer Program Products

To determine and identify sequence identities, structural homologies, motifs and the like in silico, the sequence of the invention can be stored, recorded, and manipulated on any medium which can be read and accessed by a computer. Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

Another aspect of the invention is a computer readable medium having recorded thereon at least one nucleic acid and/or polypeptide sequence of the invention. Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., internet based systems), particularly computer systems, which store and manipulate the sequences and sequence information described herein. One example of a computer system 100 is illustrated in block diagram form in FIG. 1. As used herein, "a computer system" refers to the hardware components, software components, and data storage components used to analyze a nucleotide or polypeptide sequence of the invention. The computer system 100 can include a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines. The computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one aspect, the computer system 100 includes a processor 105 connected to a bus which is connected to a main memory 115 (preferably implemented as RAM) and one or more internal data storage devices 110, such as a hard drive and/or other computer readable media having data recorded thereon. The computer system 100 can further include one or more data retrieving device 118 for reading the data stored on the internal data storage devices 110. The data retrieving device 118 may represent, for example, a floppy disk drive, a compact disk drive, a magnetic tape drive, or a modem capable of connection to a remote data storage system (e.g., via the internet) etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device. The computer system 100 includes a display 120 which is used to display output to a computer user. It should also be noted that the computer system 100 can be linked to other computer systems 125a-c in a network or wide area network to provide centralized access to the computer system 100. Software for accessing and processing the nucleotide or amino acid sequences of the invention can reside in main memory 115 during execution. In some aspects, the computer system 100 may further comprise a sequence comparison algorithm for comparing a nucleic acid sequence of the invention. The algorithm and sequence(s) can be stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of the invention stored on a computer readable medium to reference sequences stored on a computer readable medium to identify homologies or structural motifs.

Figure 2:
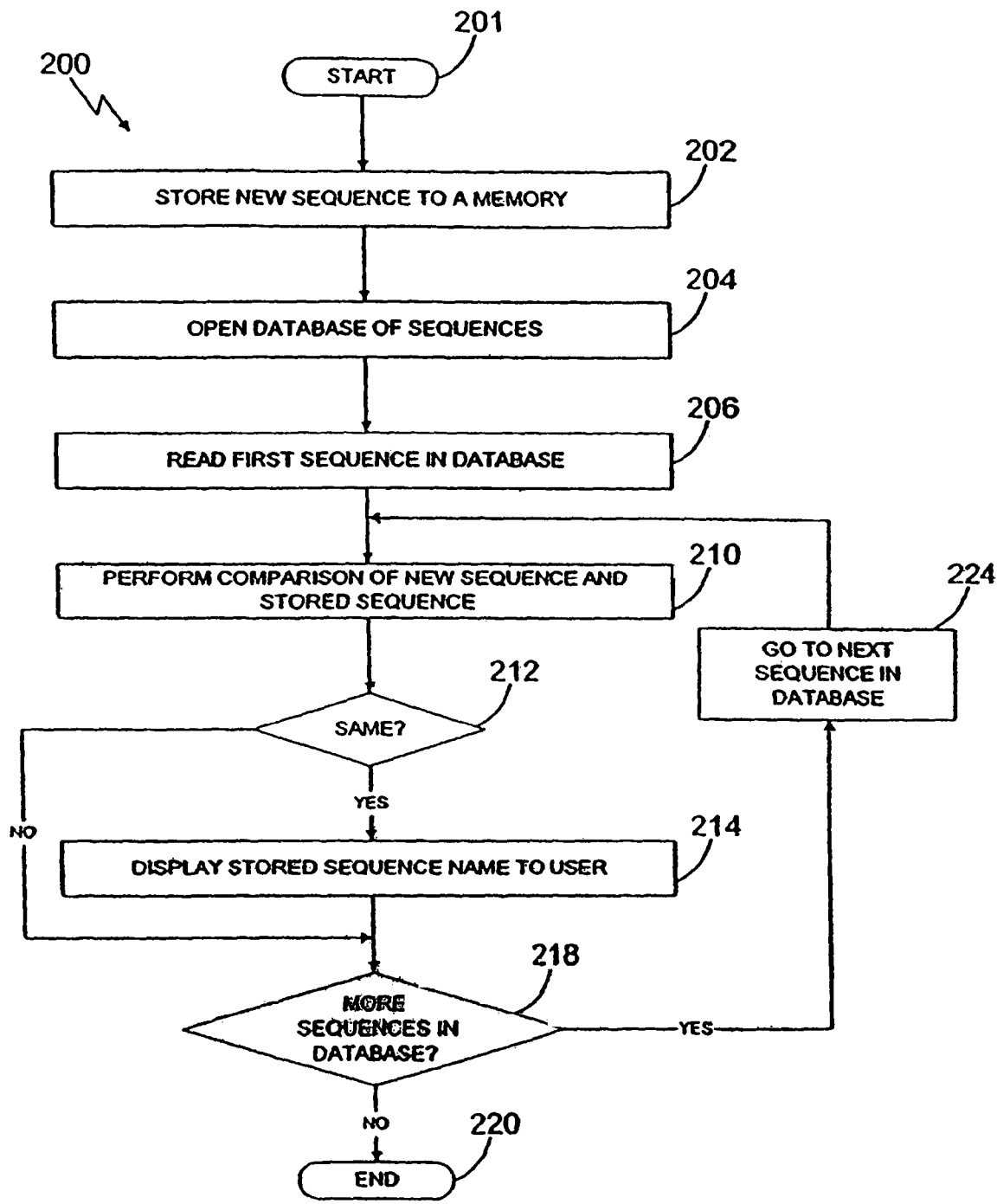
FIG. 2 is a flow diagram illustrating one aspect of a process for comparing a new nucleotide or protein sequence with a database of sequences in order to determine the homology levels between the new sequence and the sequences in the database.
Figure 3:
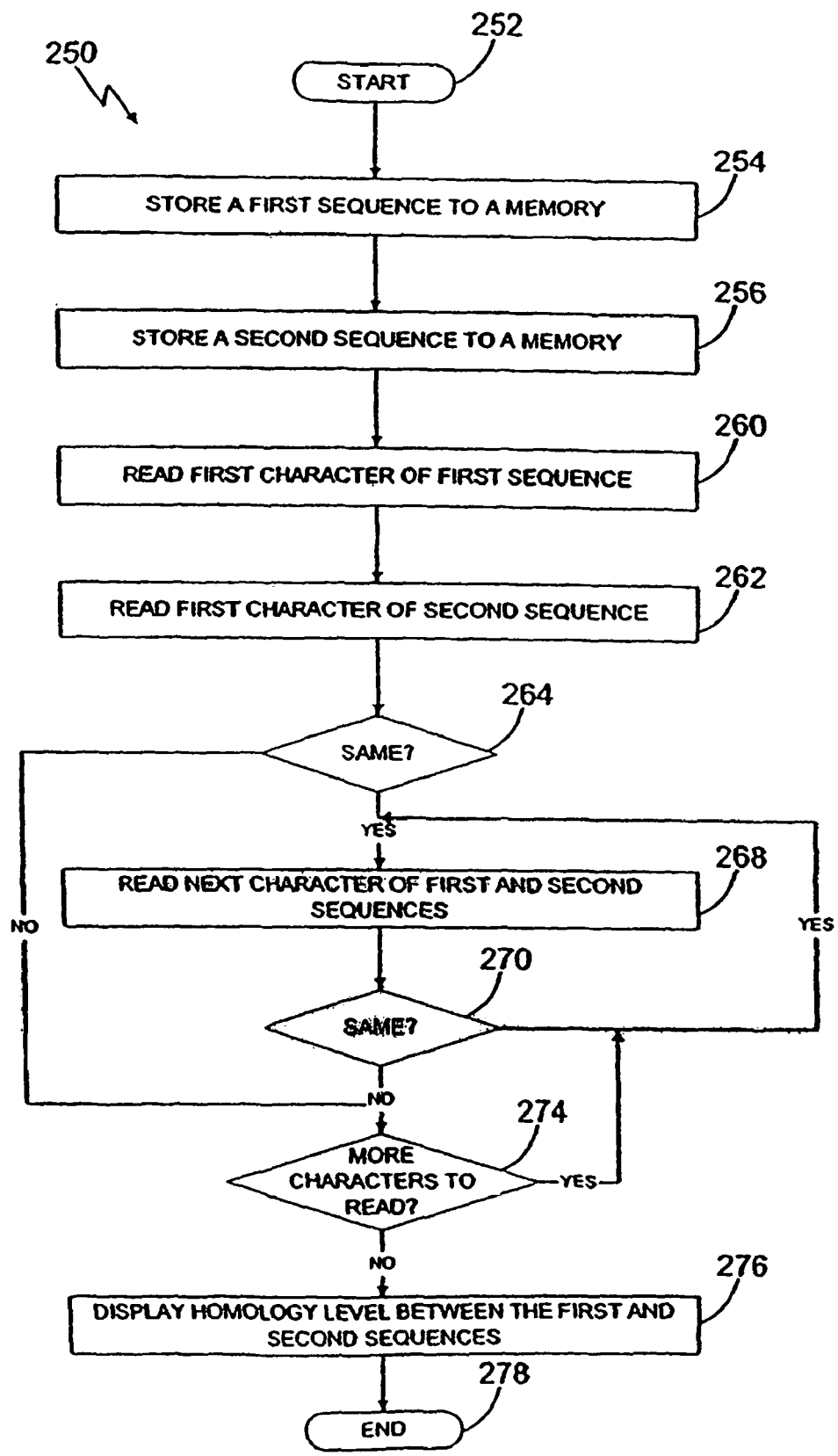
FIG. 3 is a flow diagram illustrating one aspect of a process in a computer for determining whether two sequences are homologous.

The parameters used with the above algorithms may be adapted depending on the sequence length and degree of homology studied. In some aspects, the parameters may be the default parameters used by the algorithms in the absence of instructions from the user. FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet. The process 200 begins at a start state 201 and then moves to a state 202 wherein the new sequence to be compared is stored to a memory in a computer system 100. As discussed above, the memory could be any type of memory, including RAM or an internal storage device. The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system. Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200. If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database. It should be noted that if a determination had been made at the decision state 212 that the sequences were not homologous, then the process 200 would move immediately to the decision state 218 in order to determine if any other sequences were available in the database for comparison. Accordingly, one aspect of the invention is a computer system comprising a processor, a data storage device having stored thereon a nucleic acid sequence of the invention and a sequence comparer for conducting the comparison. The sequence comparer may indicate a homology level between the sequences compared or identify structural motifs, or it may identify structural motifs in sequences which are compared to these nucleic acid codes and polypeptide codes. FIG. 3 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it can be a single letter amino acid code so that the first and sequence sequences can be easily compared. A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read. If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with an every character in a second sequence, the homology level would be 100%.

Alternatively, the computer program can compare a reference sequence to a sequence of the invention to determine whether the sequences differ at one or more positions. The program can record the length and identity of inserted, deleted or substituted nucleotides or amino acid residues with respect to the sequence of either the reference or the invention. The computer program may be a program which determines whether a reference sequence contains a single nucleotide polymorphism (SNP) with respect to a sequence of the invention, or, whether a sequence of the invention comprises a SNP of a known sequence. Thus, in some aspects, the computer program is a program which identifies SNPs. The method may be implemented by the computer systems described above and the method illustrated in FIG. 3. The method can be performed by reading a sequence of the invention and the reference sequences through the use of the computer program and identifying differences with the computer program.

Figure 4:
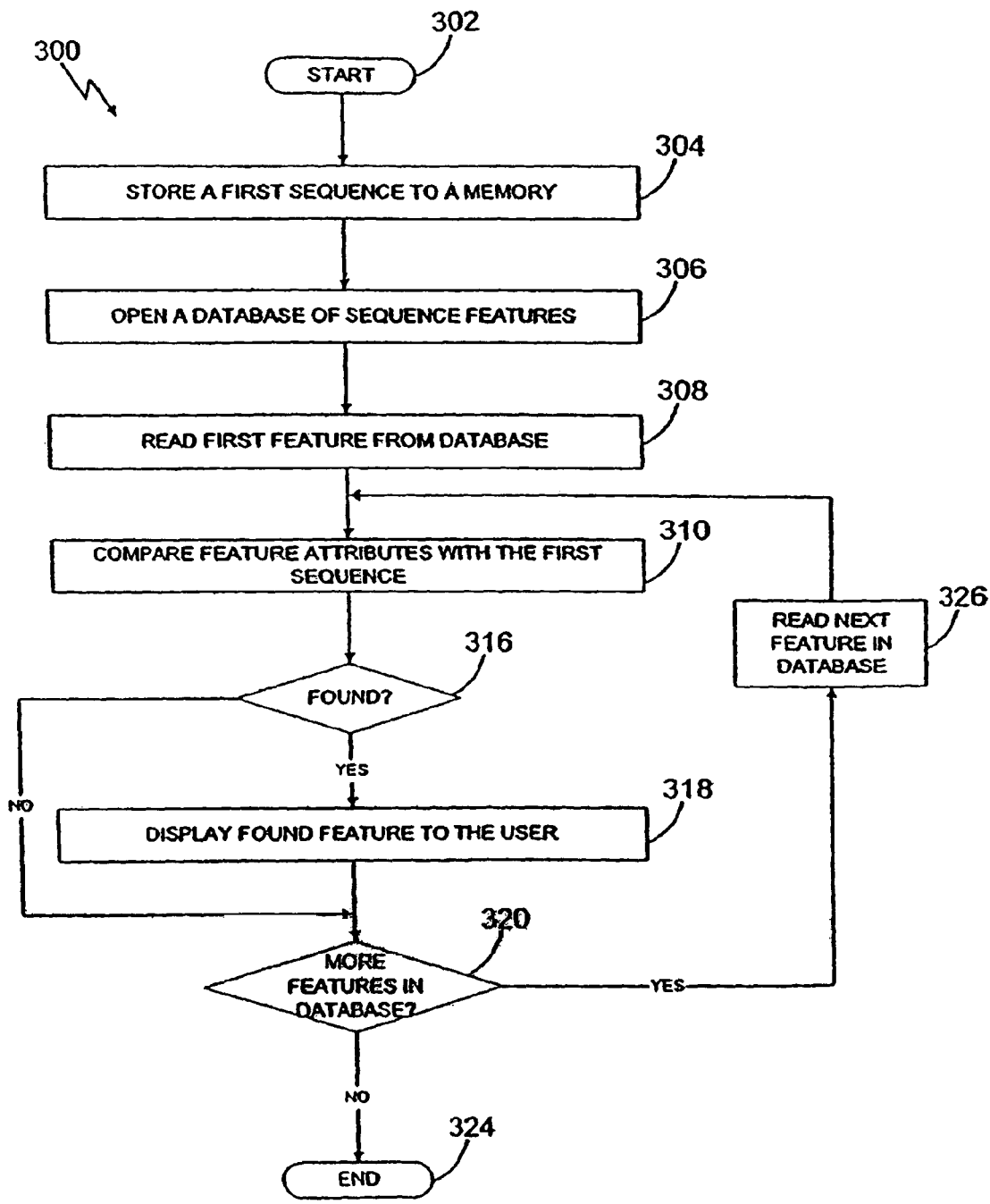
FIG. 4 is a flow diagram illustrating one aspect of an identifier process 300 for detecting the presence of a feature in a sequence.

In other aspects the computer based system comprises an identifier for identifying features within a nucleic acid or polypeptide of the invention. An "identifier" refers to one or more programs which identifies certain features within a nucleic acid sequence. For example, an identifier may comprise a program which identifies an open reading frame (ORF) in a nucleic acid sequence. FIG. 4 is a flow diagram illustrating one aspect of an identifier process 300 for detecting the presence of a feature in a sequence: The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art. Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user. The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. If the feature attribute is not found in the first sequence at the decision state 316, the process 300 moves directly to the decision state 320 in order to determine if any more features exist in the database. Thus, in one aspect, the invention provides a computer program that identifies open reading frames (ORFs).

A polypeptide or nucleic acid sequence of the invention can be stored and manipulated in a variety of data processor programs in a variety of formats. For example, a sequence can be stored as text in a word processing file, such as Microsoft-WORD or WORDPERFECT or as an ASCII file in a variety of database programs familiar to those of skill in the art, such as DB2, SYBASE, or ORACLE. In addition, many computer programs and databases may be used as sequence comparison algorithms, identifiers, or sources of reference nucleotide sequences or polypeptide sequences to be compared to a nucleic acid sequence of the invention. The programs and databases used to practice the invention include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius2.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwent's World Drug Index database, the BioByteMasterFile database, the Genbank database, and the Genseqn database. Many other programs and data bases would be apparent to one of skill in the-art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

Hybridization of Nucleic Acids

The invention provides isolated or recombinant nucleic acids that hybridize under stringent conditions to an exemplary sequence of the invention, or a nucleic acid that encodes a polypeptide of the invention. The stringent conditions can be highly stringent conditions, medium stringent conditions, low stringent conditions, including the high and reduced stringency conditions described herein. In one aspect, it is the stringency of the wash conditions that set forth the conditions which determine whether a nucleic acid is within the scope of the invention, as discussed below.

In alternative embodiments, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA, antisense or sequences encoding antibody binding peptides (epitopes), motifs, active sites and the like.

In one aspect, nucleic acids of the invention are defined by their ability to hybridize under high stringency comprises conditions of about 50% forrnamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5× SSPE, 0.3% SDS, and a repetitive sequence blocking nucleic acid, such as cot-1 or salmon sperm DNA (e.g., 200 n/ml sheared and denatured salmon sperm DNA). In one aspect, nucleic acids of the invention are defined by their ability to hybridize under reduced stringency conditions comprising 35% formamide at a reduced temperature of 35° C.

Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

The temperature range corresponding to a particular level of stringency can be further narrowed by calculating the purine to pyrimidine ratio of the nucleic acid of interest and adjusting the temperature accordingly. Nucleic acids of the invention are also defined by their ability to hybridize under high, medium, and low stringency conditions as set forth in Ausubel and Sambrook. Variations on the above ranges and conditions are well known in the art. Hybridization conditions are discussed further, below.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel for a description of SSC buffer and equivalent conditions.

These methods may be used to isolate nucleic acids of the invention.

Oligonucleotides Probes and Methods for Using Them

The invention also provides nucleic acid probes that can be used, e.g., for identifying nucleic acids encoding a polypeptide with an amylase activity or fragments thereof or for identifying amylase genes. In one aspect, the probe comprises at least 10 consecutive bases of a nucleic acid of the invention. Alternatively, a probe of the invention can be at least about 5, 6, 7, 8, 9, 10, 15, 20, 25, 30, 35, 40, 45, 50, 60, 70, 80, 90, 100, 110, 120, 130, 150 or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The probes of the invention can be used to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences present in the sample. Where necessary, conditions which permit the probe to specifically hybridize to complementary sequences may be determined by placing the probe in contact with complementary sequences from samples known to contain the complementary sequence, as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids (see discussion on specific hybridization conditions).

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product. Many methods for using the labeled probes to detect the presence of complementary nucleic acids in a sample are familiar to those skilled in the art. These include Southern Blots, Northern Blots, colony hybridization procedures, and dot blots. Protocols for each of these procedures are provided in Ausubel and Sambrook.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). In one aspect, the probes comprise oligonucleotides. In one aspect, the amplification reaction may comprise a PCR reaction. PCR protocols are described in Ausubel and Sambrook (see discussion on amplification reactions). In such procedures, the nucleic acids in the sample are contacted with the probes, the amplification reaction is performed, and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the 3' or 5' ends of a nucleic acid sequence of the invention can also be used in chromosome walking procedures to identify clones containing additional, e.g., genomic sequences. Such methods allow the isolation of genes which encode additional proteins of interest from the host organism.

In one aspect, nucleic acid sequences of the invention are used as probes to identify and isolate related nucleic acids. In some aspects, the so-identified related nucleic acids may be cDNAs or genomic DNAs from organisms other than the one from which the nucleic acid of the invention was first isolated. In such procedures, a nucleic acid sample is contacted with the probe under conditions which permit the probe to specifically hybridize to related sequences. Hybridization of the probe to nucleic acids from the related organism is then detected using any of the methods described above.

In nucleic acid hybridization reactions, the conditions used to achieve a particular level of stringency can vary, depending on the nature of the nucleic acids being hybridized. For example, the length, degree of complementarity, nucleotide sequence composition (e.g., GC v. AT content), and nucleic acid type (e.g., RNA v. DNA) of the hybridizing regions of the nucleic acids can be considered in selecting hybridization conditions. An additional consideration is whether one of the nucleic acids is immobilized, for example, on a filter. Hybridization can be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM $NaH_2PO_4$, pH 7.0, 5.0 mM $Na_2EDTA$, 0.5% SDS, 10× Denhardt's, and 0.5 mg/ml polyriboadenylic acid. Approximately $2 \times 10^7$ cpm (specific activity $4$-$9 \times 10^8$ cpm/ug) of $^{32}P$ end-labeled oligonucleotide probe can then added to the solution. After 12-16 hours of incubation, the membrane is washed for 30 minutes at room temperature (RT) in 1× SET (150 mM NaCl, 20 mM Tris hydrochloride, pH 7.8, 1 mM $Na_2EDTA$) containing 0.5% SDS, followed by a 30 minute wash in fresh 1× SET at Tm-10° C. for the oligonucleotide probe. The membrane is then exposed to auto-radiographic film for detection of hybridization signals.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, Tm, is the temperature (under defined ionic strength and pH) at which 50% of the target sequence hybridizes to a perfectly complementary probe. Very stringent conditions are selected to be equal to or about 5° C. lower than the Tm for a particular probe. The melting temperature of the probe may be calculated using the following exemplary formulas. For probes between 14 and 70 nucleotides in length the melting temperature (Tm) is calculated using the formula: Tm=81.5+16.6(log [Na+])+0.41(fraction G+C)−(600/N) where N is the length of the probe. If the hybridization is carried out in a solution containing formamide, the melting temperature may be calculated using the equation: Tm=8 1.5+16.6(log [Na+])+0.41 (fraction G+C)−(0.63 % formamide)−(600/N) where N is the length of the probe. Prehybridization may be carried out in 6×SSC, 5× Denhardt's reagent, 0.5% SDS, 100 µg denatured fragmented salmon sperm DNA or 6×SSC, 5× Denhardt's reagent, 0.5% SDS, 100 µg denatured fragmented salmon sperm DNA, 50% formamide. Formulas for SSC and Denhardt's and other solutions are listed, e.g., in Sambrook.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the Tm. For shorter probes, such as oligonucleotide probes, the hybridization may be conducted at 5-10° C. below the Tm. In one aspect, hybridizations in 6×SSC are conducted at approximately 68° C. In one aspect, hybridizations in 50% formamide containing solutions are conducted at approximately 42° C. All of the foregoing hybridizations would be considered to be under conditions of high stringency.

Following hybridization, the filter is washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content), and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes.

Nucleic acids which have hybridized to the probe can be identified by autoradiography or other conventional techniques. The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. An example of "moderate" hybridization conditions is when the above hybridization is conducted at 55° C. An example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

These probes and methods of the invention can be used to isolate nucleic acids having a sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity ("homology") to a nucleic acid sequence of the invention comprising at least about 10, 15, 20, 25, 30, 35, 40, 50, 75, 100, 150, 200, 250, 300, 350, 400, 500, 550, 600, 650, 700, 750, 800, 850, 900, 950, 1000, or more consecutive bases thereof, and the sequences complementary thereto. Homology may be measured using an alignment algorithm, as discussed herein. For example, the homologous polynucleotides may have a coding sequence which is a naturally occurring allelic variant of one of the coding sequences described herein. Such allelic variants may have a substitution, deletion or addition of one or more nucleotides when compared to a nucleic acid of the invention.

Additionally, the probes and methods of the invention can be used to isolate nucleic acids which encode polypeptides having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%, sequence identity (homology) to a polypeptide of the invention comprising at least 5, 10, 15, 20, 25, 30, 35, 40, 50, 75, 100, or 150 consecutive amino acids, as determined using a sequence alignment algorithm (e.g., such as the FASTA version 3.0t78 algorithm with the default parameters, or a BLAST 2.2.2 program with exemplary settings as set forth herein).

Inhibiting Expression of Amylase

The invention provides nucleic acids complementary to (e.g., antisense sequences to) the nucleic acid sequences of the invention. Antisense sequences are capable of inhibiting the transport, splicing or transcription of amylase-encoding genes. The inhibition can be effected through the targeting of genomic DNA or messenger RNA. The transcription or function of targeted nucleic acid can be inhibited, for example, by hybridization and/or cleavage. One particularly useful set of inhibitors provided by the present invention includes oligonucleotides which are able to either bind amylase gene or message, in either case preventing or inhibiting the production or function of amylase. The association can be through sequence specific hybridization. Another useful class of inhibitors includes oligonucleotides which cause inactivation or cleavage of amylase message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity.

Antisense Oligonucleotides

The invention provides antisense oligonucleotides capable of binding amylase message which can inhibit proteolytic activity by targeting mRNA. Strategies for designing antisense oligonucleotides are well described in the scientific and patent literature, and the skilled artisan can design such amylase oligonucleotides using the novel reagents of the invention. For example, gene walking/ RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Phannacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense amylase sequences of the invention (see, e.g., Gold (1995) J. of Biol. Chem. 270:13581-13584).

Inhibitory Ribozymes

The invention provides ribozymes capable of binding amylase message. These ribozymes can inhibit amylase activity by, e.g., targeting mRNA. Strategies for designing ribozymes and selecting the amylase-specific antisense sequence for targeting are well described in the scientific and patent literature, and the skilled artisan can design such ribozymes using the novel reagents of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozymne molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising an amylase sequence of the invention. The RNAi molecule comprises a double-stranded RNA (dsRNA) molecule. The RNAi can inhibit expression of an amylase gene. In one aspect, the RNAi is about 15, 16, 17, 18, 19, 20, 21, 22, 23, 24, 25 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's of the invention. The process may be practiced in vitro, ex vivo or in vivo. In one aspect, the RNAi molecules of the invention can be used to generate a loss-of-function mutation in a cell, an organ or an animal. Methods for making and using RNAi molecules for selectively degrade RNA are well known in the art, see, e.g., U.S. Pat. Nos. 6,506,559; 6,511, 824; 6,515,109; 6,489,127.

Modification of Nucleic Acids

The invention provides methods of generating variants of the nucleic acids of the invention, e.g., those encoding an amylase. These methods can be repeated or used in various combinations to generate amylases having an altered or different activity or an altered or different stability from that of an amylase encoded by the template nucleic acid. These methods also can be repeated or used in various combinations, e.g., to generate variations in gene/ message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photo-activated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, gene site saturated mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'" Journal of Molecular Biology 255:373-386; Stemmer (1996) "Sexual PCR and Assembly PCR" In: The Encyclopedia of Molecular Biology. VCH Publishers, New York. pp.447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J.237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller & Smith (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100: 468-500; and Zoller & Smith (1987) Oligonucleotide-directed mutagenesis: a simple method using two oligonucleotide primers and a single-stranded DNA template"Methods in Enzymol. 154:329-350); phosphorothioate-modified DNA mutagenesis (Taylor et al. (1985) "The use of phosphorothioate-modified DNA in restriction enzyme reactions to prepare nicked DNA" Nucl. Acids Res. 13: 8749-8764; Taylor et al. (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers et al. (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer et al. (1988) "Improved enzymatic in vitro reactions in the gapped duplex DNA approach to oligonucleotide-directed construction of mutations" Nucl. Acids Res. 16: 7207; and Fritz et al. (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene.34:315-323; and Grundstrom et al. (1985) "Oligonucleotide-directed mutagenesis by microscale 'shot-gun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of *Escherichia coli*: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. Nos. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837, 458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. patent application Ser. No. (U.S. Ser. No.) 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368, 861; 6,376,246; 6,423,542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436,675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., gene site saturation mutagenesis (GSSM™, synthetic ligation reassembly (SLR), or a combination thereof are used to modify the nucleic acids of the invention to generate amylases with new or altered properties (e.g., activity under highly acidic or alkaline conditions, high temperatures, and the like). Polypeptides encoded by the modified nucleic acids can be screened for an activity before testing for proteolytic or other activity. Any testing modality or protocol can be used, e.g., using a capillary array platform. See, e.g., U.S. Pat. Nos. 6,361,974; 6,280,926; 5,939,250.

Saturation Mutagenesis, or, GSSM™

In one aspect, codon primers containing a degenerate N,N, G/T sequence are used to introduce point mutations into a polynucleotide, e.g., an amylase or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, optionally, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used— either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N,G/T sequences can be directly contiguous, or separated by one or more additional nucleotide sequence(s). In another aspect, oligonucleotides serviceable for introducing additions and deletions can be used either alone or in combination with the codons containing an N,N,G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position X 100 amino acid positions) can be generated. Through the use of an oligonucleotide or set of oligonucleotides containing a degenerate N,N,G/T triplet, 32 individual sequences can code for all 20 possible natural amino acids. Thus, in a reaction vessel in which a parental polynucleotide sequence is subjected to saturation mutagenesis using at least one such-oligonucleotide, there are generated 32 distinct progeny polynucleotides encoding distinct polypeptides. In contrast, the use of a non-degenerate oligonucleotide in site-directed mutagenesis leads to only one progeny polypeptide product per reaction vessel. Nondegenerate oligonucleotides can optionally be used in combination with degenerate primers disclosed; for example, nondegenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., amylases) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., E. coli host, using, e.g., an expression vector) and subjected to expression screening. When an individual progeny polypeptide is identified by screening to display a favorable change in property (when compared to the parental polypeptide, such as increased proteolytic activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined −6 single point mutations (i.e. 2 at each of three positions) and no change at any position.

In another aspect, site-saturation mutagenesis can be used together with another stochastic or non-stochastic means to vary sequence, e.g., synthetic ligation reassembly (see below), shuffling, chimerization, recombination and other mutagenizing processes and mutagenizing agents. This invention provides for the use of any mutagenizing process(es), including saturation mutagenesis, in an iterative manner.

Synthetic Ligation Reassembly (SLR)

The invention provides a non-stochastic gene modification system termed "synthetic ligation reassembly," or simply "SLR," a "directed evolution process," to generate polypeptides, e.g., amylases or antibodies of the invention, with new or altered properties. SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. patent application Ser. No. (USSN) 09/332,835 entitled "Synthetic Ligation Reassembly in Directed Evolution" and filed on Jun. 14, 1999 ("U.S. Ser. No. 09/332,835"). In one aspect, SLR comprises the following steps: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over $10^{100}$ different chimeras. SLR can be used to generate libraries comprised of over $10^{1000}$ different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are preferably shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more preferably a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated preferably comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

In another aspect, the synthetic nature of the step in which the building blocks are generated allows the design and introduction of nucleotides (e.g., one or more nucleotides, which may be, for example, codons or introns or regulatory sequences) that can later be optionally removed in an in vitro process (e.g. by mutagenesis) or in an in vivo process (e.g. by utilizing the gene splicing ability of a host organism). It is appreciated that in many instances the introduction of these nucleotides may also be desirable for many other reasons in addition to the potential benefit of creating a serviceable demarcation point.

In one aspect, a nucleic acid building block is used to introduce an intron. Thus, functional introns are introduced into a man-made gene manufactured according to the methods described herein. The artificially introduced intron(s) can be functional in a host cells for gene splicing much in the way that naturally-occurring introns serve functionally in gene splicing.

Optimized Directed Evolution System

The invention provides a non-stochastic gene modification system termed "optimized directed evolution system" to generate polypeptides, e.g., amylases or antibodies of the invention, with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems.

Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. Additional information can also be found, e.g., in U.S. Ser. No. 09/332,835; U.S. Pat. No. 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. See also U.S. Ser. No. 09/332,835.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is preferably performed in MATLABT (The Mathworks, Natick, Massachusetts) a programming language and development environment for technical computing.

Iterative Processes

In practicing the invention, these processes can be iteratively repeated. For example, a nucleic acid (or, the nucleic acid) responsible for an altered or new amylase phenotype is identified, re-isolated, again modified, re-tested for activity. This process can be iteratively repeated until a desired phenotype is engineered. For example, an entire biochemical anabolic or catabolic pathway can be engineered into a cell, including, e.g., starch hydrolysis activity.

Similarly, if it is determined that a particular oligonucleotide has no affect at all on the desired trait (e.g., a new amylase phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In vivo shuffling of molecules is use in methods of the invention that provide variants of polypeptides of the invention, e.g., antibodies, amylases, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In one aspect, the invention provides a method for producing a hybrid polynucleotide from at least a first polynucleotide (e.g., an amylase of the invention) and a second polynucleotide (e.g., an enzyme, such as an amylase of the invention or any other amylase, or, a tag or an epitope). The invention can be used to produce a hybrid polynucleotide by introducing at least a first polynucleotide and a second polynucleotide which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

Producing Sequence Variants

The invention also provides additional methods for making sequence variants of the nucleic acid (e.g., amylase) sequences of the invention. The invention also provides additional methods for isolating amylases using the nucleic acids and polypeptides of the invention. In one aspect, the invention provides for variants of an amylase coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate nucleic acids which encode polypeptides having characteristics which enhance their value in industrial or laboratory applications. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung, D. W., et al., Technique, 1:11-15, 1989) and Caldwell, R. C. & Joyce G. F., PCR Methods Applic., 2:28-33, 1992. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7mM MgCl2, 0.5mM $MnCl_2$, 5 units of Taq polymerase, 0.2mM dGTP, 0.2mM DATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids is evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/:1 in a solution of 0.2 mM of each dNTP, 2.2 mM $MgCl_2$, 50 mM KCL, 10 mM Tris HCl, pH 9.0, and 0.1 % Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some aspects, random mutations in a sequence of interest are generated by propagating the sequence of interest in a bacterial strain, such as an *E. coli* strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described, e.g., in PCT Publication No. WO 91/16427.

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described, e.g., in Arkin (1992) Proc. Natl. Acad. Sci. USA 89:7811-7815

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described, e.g., in Delegrave (1993) Biotechnology Res. 11: 1548-1552. Random and site-directed mutagenesis are described, e.g., in Arnold (1993) Current Opinion in Biotechnology 4:450-455.

In some aspects, the variants are created using shuffling procedures wherein portions of a plurality of nucleic acids which encode distinct polypeptides are fused together to create chimeric nucleic acid sequences which encode chimeric polypeptides as described in, e.g., U.S. Pat. Nos. 5,965,408; 5,939,250 (see also discussion, above).

The invention also provides variants of polypeptides of the invention (e.g., amylases) comprising sequences in which one or more of the amino acid residues (e.g., of an exemplary polypeptide of the invention) are substituted with a conserved or non-conserved amino acid residue (e.g., a conserved amino acid residue) and such substituted amino acid residue may or may not be one encoded by the genetic code. Conservative substitutions are those that substitute a given amino acid in a polypeptide by another amino acid of like characteristics. Thus, polypeptides of the invention include those with conservative substitutions of sequences of the invention, e.g., the exemplary polypeptides of the invention, including but not limited to the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue. Other variants are those in which one or more of the amino acid residues of the polypeptides of the invention includes a substituent group.

Other variants within the scope of the invention are those in which the polypeptide is associated with another compound, such as a compound to increase the half-life of the polypeptide, for example, polyethylene glycol.

Additional variants within the scope of the invention are those in which additional amino acids are fused to the polypeptide, such as a leader sequence, a secretory sequence, a proprotein sequence or a sequence which facilitates purification, enrichment, or stabilization of the polypeptide.

In some aspects, the variants, fragments, derivatives and analogs of the polypeptides of the invention retain the same biological function or activity as the exemplary polypeptides, e.g., amylase activity, as described herein. In other aspects, the variant, fragment, derivative, or analog includes a proprotein, such that the variant, fragment, derivative, or analog can be activated by cleavage of the proprotein portion to produce an active polypeptide.

Optimizing Codons to Achieve High Levels of Protein Expression in Host Cells

The invention provides methods for modifying amylase-encoding nucleic acids to modify codon usage. In one aspect, the invention provides methods for modifying codons in a nucleic acid encoding an amylase to increase or decrease its expression in a host cell. The invention also provides nucleic acids encoding an amylase modified to increase its expression in a host cell, amylase so modified, and methods of making the modified amylases. The method comprises identifying a "non-preferred" or a "less preferred" codon in amylase-encoding nucleic acid and replacing one or more of these non-preferred or less preferred codons with a "preferred codon"

encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as *Escherichia coli*; gram positive bacteria, such as *Bacillus cereus, Streptomyces, Lactobacillus gasseri, Lactococcus lactis, Lactococcus cremoris, Bacillus subtilis*. Exemplary host cells also include eukaryotic organisms, e.g., various yeast, such as *Saccharomyces* sp., including *Saccharomyces cerevisiae, Schizosaccharomyces pombe, Pichia pastoris*, and *Kluyveromyces lactis, Hansenula polymorpha, Aspergillus niger*, and mammalian cells and cell lines and insect cells and cell lines. Thus, the invention also includes nucleic acids and polypeptides optimized for expression in these organisms and species.

For example, the codons of a nucleic acid encoding an amylase isolated from a bacterial cell are modified such that the nucleic acid is optimally expressed in a bacterial cell different from the bacteria from which the amylase was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in *E. coli*; Humphreys (2000) Protein Expr. Purif 20:252-264, describing optimizing codon usage that affects secretion in *E. coli*.

Transgenic Non-Human Animals

The invention provides transgenic non-human animals comprising a nucleic acid, a polypeptide (e.g., an amylase), an expression cassette or vector or a transfected or transformed cell of the invention. The invention also provides methods of making and using these transgenic non-human animals.

The transgenic non-human animals can be, e.g., goats, rabbits, sheep, pigs, cows, rats and mice, comprising the nucleic acids of the invention. These animals can be used, e.g., as in vivo models to study amylase activity, or, as models to screen for agents that change the amylase activity in vivo. The coding sequences for the polypeptides to be expressed in the transgenic non-human animals can be designed to be constitutive, or, under the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111,166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice whose cells express proteins related to the pathology of Alzheimer's disease. U.S. Pat. No. 6,187,992, describes making and using a transgenic mouse whose genome comprises a disruption of the gene encoding amyloid precursor protein (APP).

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing an amylase of the invention, or, a fusion protein comprising an amylase of the invention.

Transgenic Plants and Seeds

The invention provides transgenic plants and seeds comprising a nucleic acid, a polypeptide (e.g., an amylase, such as an alpha amylase), an expression cassette or vector or a transfected or transformed cell of the invention. The invention also provides plant products, e.g., oils, seeds, leaves, extracts and the like, comprising a nucleic acid and/or a polypeptide (e.g., an amylase, such as an alpha amylase) of the invention. The transgenic plant can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's a-amylase production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

The nucleic acids of the invention can be used to confer desired traits on essentially any plant, e.g., on starch-producing plants, such as potato, wheat, rice, barley, and the like. Nucleic acids of the invention can be used to manipulate metabolic pathways of a plant in order to optimize or alter host's expression of a-amylase. The can change the ratio of starch/sugar conversion in a plant. This can facilitate industrial processing of a plant. Alternatively, alpha-amylases of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, optionally, marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327: 70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) *Science* 233:496-498; Fraley (1983) *Proc. Natl. Acad. Sci. USA* 80:4803 (1983); *Gene Transfer to Plants,* Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl Acad. Sci USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture,* pp. 124-176, MacMillilan Publishing Company, New York, 1983; and Binding, *Regeneration of Plants, Plant Protoplasts,* pp. 21-73, CRC Press, Boca Raton, 1985. Regeneration can also be obtained from plant callus, explants, organs, or parts thereof Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., an amylase, such as an alpha amylase) of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as festuca, lolium, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna,* and *Zea*.

In alternative embodiments, the nucleic acids of the invention are expressed in plants which contain fiber cells, including, e.g., cotton, silk cotton tree (Kapok, *Ceiba pentandra*), desert willow, creosote bush, winterfat, balsa, ramie, kenaf, hemp, roselle, jute, sisal abaca and flax. In alternative embodiments, the transgenic plants of the invention can be members of the genus *Gossypium*, including members of any *Gossypium* species, such as *G. arboreum; G. herbaceum, G. barbadense,* and *G. hirsutum*.

The invention also provides for transgenic plants to be used for producing large amounts of the polypeptides (e.g., an amylase, such as an alpha amylase) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas1',2') promoter with *Agrobacterium tumefaciens*-mediated leaf disc transformation methods).

Using known procedures, one of skill can screen for plants of the invention by detecting the increase or decrease of transgene mRNA or protein in transgenic plants. Means for detecting and quantitation of mRNAs or proteins are well known in the art.

Polypeptides and Peptides

In one aspect, the invention provides isolated or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity) to an exemplary sequence of the invention, e.g., SEQ ID NO:2, SEQ ID NO:4, SEQ ID NO:6, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:190, SEQ ID NO:192, SEQ ID NO:194, SEQ ID NO:204, SEQ ID NO:206, SEQ ID NO:208, SEQ ID NO:210, SEQ ID NO:212, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377, SEQ ID NO:379, SEQ ID NO:381, SEQ ID NO:383, SEQ ID NO:385, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:461, SEQ ID NO:463, SEQ ID NO:464, SEQ ID NO:466, SEQ ID NO:468, SEQ ID NO:469, SEQ ID NO:470, SEQ ID NO:471, SEQ ID NO:472, SEQ ID NO:474, SEQ ID NO:476, SEQ ID NO:477, SEQ ID NO:479, SEQ ID NO:481, SEQ ID NO:482, SEQ ID NO:483, SEQ ID NO:485, SEQ ID NO:487, SEQ ID NO:488, SEQ ID NO:489, SEQ ID NO:490, SEQ ID NO:491, SEQ ID NO:493, SEQ ID NO:495, SEQ ID NO:496, SEQ ID NO:497, SEQ ID NO:499, SEQ ID NO:501, SEQ ID NO:502, SEQ ID NO:503, SEQ ID NO:504, SEQ ID NO:505, SEQ ID NO:506, SEQ ID NO:507, SEQ ID NO:508, SEQ ID NO:510, SEQ ID NO:512, SEQ ID NO:513, SEQ ID NO:514, SEQ ID NO:516, SEQ ID NO:518, SEQ ID NO:518, SEQ ID NO:520, SEQ ID NO:521, SEQ ID NO:523, SEQ ID NO:525, SEQ ID NO:526, SEQ ID NO:528, SEQ ID NO:530, SEQ ID NO:531, SEQ ID NO:533, SEQ ID NO:535, SEQ ID NO:536, SEQ ID NO:537, SEQ ID NO:538, SEQ ID NO:540, SEQ ID NO:542, SEQ ID NO:543, SEQ ID NO:545, SEQ ID NO:547, SEQ ID NO:548, SEQ ID NO:549, SEQ ID NO:550, SEQ ID NO:551, SEQ ID NO:553, SEQ ID NO:555, SEQ ID NO:556, SEQ ID NO:557, SEQ ID NO:559, SEQ ID NO:561, SEQ ID NO:562, SEQ ID NO:563, SEQ ID NO:564, SEQ ID NO:566, SEQ ID NO:568, SEQ ID NO:570, SEQ ID NO:572, SEQ ID NO:574, SEQ ID NO:576, SEQ ID NO:578, SEQ ID NO:580, SEQ ID NO:582, SEQ ID NO:584, SEQ ID NO:586, SEQ ID NO:588, SEQ ID NO:589, SEQ ID NO:590, SEQ ID NO:591, SEQ ID NO:592, SEQ ID NO:594, SEQ ID NO:604, SEQ ID NO:606, SEQ ID NO:608, SEQ ID NO:610, SEQ ID NO:612, SEQ ID NO:614, SEQ ID NO:616, SEQ ID NO:618, SEQ ID NO:620 or SEQ ID NO:622, and subsequences thereof and variants thereof In one aspect, the polypeptide has an amylase activity, e.g., an alpha amylase activity or a glucoamylase activity.

The identity can be over the full length of the polypeptide, or, the identity can be over a region of at least about 10, 15, 20, 25, 30, 35, 40, 45, 50, 55, 60, 65, 70, 75, 80, 90, 100, 125, 150, 175, 200, 250, 300, 350, 400, 450, 500, 550, 600, 650, 700 or more residues. Polypeptides of the invention can also be shorter than the full length of exemplary polypeptides. In alternative aspects, the invention provides polypeptides (peptides, fragments) ranging in size between about 5 and the full length of a polypeptide, e.g., an enzyme, such as an amylase; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary amylase of the invention. Peptides of the invention can be useful as, e.g., labeling probes, antigens, toleragens, motifs, amylase active sites.

For example, the following table summarizes characteristics (e.g., activity, initial source, signal sequence location and exemplary signal sequence) of exemplary polypeptides of the invention. For example, the polypeptide having a sequence as set forth in SEQ ID NO:437, encoded by SEQ ID NO:436, was artificially generated; the polypeptide having a sequence as set forth in SEQ ID NO:439, encoded by SEQ ID NO:438, has amylase activity under alkaline conditions and was initially derived (isolated) from an unknown source; the polypeptide having a sequence as set forth in SEQ ID NO:441, encoded by SEQ ID NO:440, has amylase activity under alkaline conditions and was initially derived (isolated) from an unknown source, and has a signal sequence consisting of amino acid residues 1 to 32 of SEQ ID NO:441 ("AA 1-32"); see also discussion below regarding signal sequences of the invention, etc.:

| SEQ ID NO: P | NOTES | Source | Signal location | Signal Sequence |
|---|---|---|---|---|
| 436, 437 | Reassembled amylase | Artificial | | |
| 438, 439 | ALKALINE AMYLASE | Unknown | | |
| 440, 441 | ALKALINE AMYLASE | Unknown | AA1-32 | MNQIVNFKSHFYRKIALLFSITFI WAAGSLSA |
| 442, 443 | ALKALINE AMYLASE | Unknown | AA1-27 | MNRYLRLAALTLALAPLAYPWG NLVRA |
| 444, 445 | ALKALINE AMYLASE | Unknown | AA1-24 | MTPFGQPMMPGARMAAANMA PVRA |
| 446, 447 | ALKALINE AMYLASE | Unknown | | |
| 448, 449 | ALKALINE AMYLASE | Unknown | AA1-23 | MRLIMKKMIILITLAWVFTGCES |
| 450, 451 | ALKALINE AMYLASE | Unknown | AA1-49 | MNDSINLYNFFPYNRPMSINKTN TMKQMINWLGSLALLMLLLSCG EATE |
| 452, 453 | ALKALINE AMYLASE | Unknown | AA1-34 | MMQLNPWFSTTLKAAGLATALA AVSACQPASESA |
| 454, 455 | ALKALINE AMYLASE | Unknown | AA1-37 | MDLLEYKNTIQRRQTMTDRKLL FIVATVILAVLVSFS |

-continued

| SEQ ID NO: P | NOTES | Source | Signal location | Signal Sequence |
|---|---|---|---|---|
| 456, 457 | ALKALINE AMYLASE | Unknown | AA1-26 | MMQLNPWFSASLKAAGLATALA AVSA |
| 458, 459 | ALKALINE AMYLASE | Unknown | AA1-29 | MFKVSLRSKDMKKLSLIVTILVLA LTLSA |
| 460, 461 | fungal | Cochliobolus heterostrophus ATCC 48331 | | |
| 462-466 | fungal | Fungal | AA1-22 | MSRSSTILFVLAAANLASLVDA |
| 467-474 | fungal | Cochliobolus heterostrophus ATCC 48331 | NOTE: AA1-122 may be removed and the remaining DNA/protein sequences still encode for an amylase | |
| 475-479 | fungal | Fungal | | |
| 480-485 | fungal | Fungal | AA1-19 | MKFSLLATIVASISPLARA |
| 486-493 | fungal | Fungal | AA1-54 | MRRKSTDKYKKVSIRAHLAACE QLAISKMLFSRTATILSLLCVQAT AISPRGSA |
| 494-499 | fungal | Fungal | AA1-22 | MGFSKMLLGALIGIASLNGVQS |
| 500-510 | fungal | Fungal | | |
| 511-516 | fungal | Fungal | AA1-21 | MKYSIIPFVPLFAGLSRAASS |
| 517, 518 | fungal | Fungal | AA1-26 | MNMNIFLLIISLAFFSTVNCYTMS NA |
| 519-523 | fungal | Fungal | | |
| 524-528 | fungal | Fungal | | |
| 529-533 | fungal | Cochliobolus heterostrophus ATCC 48331 | | |
| 534-540 | fungal | Cochliobolus heterostrophus ATCC 48331 | AA1-20 | MLLLNIFTTLFFYITCIVSA |
| 541-545 | fungal | Fungal | | |
| 546-553 | fungal | Fungal | AA1-23 | MASSLLSSLSSISTFNSTQILQA |
| 554-559 | fungal | Cochliobolus heterostrophus ATCC 48331 | AA1-19 | MTTALSSGQVAPTPHTAAA |
| 560-566 | fungal | Fungal | AA1-33 | MLTTSERKTSTAFVTWSMLWVV LLTSFVKDVHA |
| 567, 568 | ALKALINE AMYLASE | Unknown | | |
| 569, 570 | | Thermococcus alcaliphilus AEDII12RA | | |
| 571, 572 | | Unknown | AA1-28 | MQSNGNVKGRSAVLALALLLLT AVAATA |
| 573, 574 | | Bacteria | AA1-27 | MKKTFKLILVLMLSLTLVFGLTAP IQA |
| 575, 576 | | Unknown | | |
| 577, 578 | | Unknown | AA1-34 | MKPFLKKSIITLLASTCLFTAWLI PSIAVPTVSA |

-continued

| SEQ ID NO: P | NOTES | Source | Signal location | Signal Sequence |
|---|---|---|---|---|
| 579, 580 | | Unknown | AA1-29 | MFKRRALGFLLAFLLVFTAVFGS MPMEFA |
| 581, 582 | | Unknown | AA1-27 | MKKFYKLTTALALSLSLALSLLG PAHA |
| 583, 584 | | Unknown | | |
| 585, 586 | | Bacteria | AA1-28 | MSLFKKSFPWILSLLLLFLFIAPF SIQT |
| 587-594 | GLUCO-AMYLASE | Thermomyces lanuginosus ATCC 200065 | AA1-23 | MLFQPTLCAALGLAALIVQGGEA |
| 603, 604 | | Unknown | AA1-31 | MQNTAKNSIWQRVRHSAIALSA LSLSFGLQA |
| 605, 606 | | Unknown | AA1-34 | MVNHLKKWIAGMALTLALLTGT VVPGLPVQVASA |
| 607, 608 | | Unknown | | |
| 609, 610 | | Unknown | AA1-31 | MQNTAKNSIWQRVRHSAIALSA LSLSFGLQA |
| 611, 612 | | Unknown | | |
| 613, 614 | | Unknown | AA1-31 | MQNTAKNSIWQRVRHSAIALSA LSLSFGLQA |
| 615, 616 | | Unknown | AA1-34 | MSERGVRRAVRTALVGLAAAAT AAVTLGAPTAQA |
| 617, 618 | | Unknown | AA1-27 | MNRYLRLAALTLALAPLAYPWG NLARA |
| 619, 620 | | Bacteria | AA1-29 | MARKSVAAALALVAGAAAVAVT GNTAAQA |
| 621, 622 | | Unknown | AA1-31 | MQNTAKNSIWQRVRHSAIALSA LSLSFGLQA |

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked. Glycosylation can be added to any polypeptide of the invention to generate an enzyme that is more thermotolerant or thermostable than the "parent" enzyme (to which the glycosylation was added). The glycosylation can be added by either chemical or by cellular biosynthetic mechanisms.

The invention provides amylases having a broad range of specific activity over a broad range of temperatures, e.g., at about 37° C. in the range from about 10 to 10,000, or, 100 to about 1000 units per milligram of protein. Amylases of the invention can also have activity at temperatures as high as 120° C. In alternative aspects, the amylase used in these methods is active at these temperatures, e.g., active at temperatures in a range of between about 80° C. to about 115° C., between about 100° C. to about 110° C., and from about 105° C. to about 108° C. However, amylases of the invention can also have activity at low temperatures, e.g., as low as 4° C. to 5° C.

The Tm of an enzyme of the invention can be shifted (for example, can be shifted between about 10° C. to 90° C.) by heat activation. For example, the Tm of SEQ ID NO:336/337 can be shifted about 17° C. to 87° C. by heat activation: for example, 80° C. preincubation for 5 minutes.

The peptides and polypeptides of the invention, as defined above, include all "mimetic" and "peptidomimetic" forms.

The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experimentation will determine whether a mimetic is within the scope of the invention, i.e., that its structure and/or function is not substantially altered. Thus, in one aspect, a mimetic composition is within the scope of the invention if it has an amylase activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like.

For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, NY).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-1, -2, 3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; D- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl)carbodiimide or 1-ethyl-3(4-azonia-4,4-dimetholpentyl)carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, preferably under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzenesulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g., an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R- or S-form.

The invention also provides methods for modifying the polypeptides of the invention by either natural processes, such as post-translational processing (e.g., phosphorylation, acylation, etc) or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431 A™ automated peptide synthesizer. Such equipment provides ready access to the peptides of the invention, either by direct synthesis or by synthesis of a series of fragments that can be coupled using other known techniques.

The invention provides novel amylases (e.g., alpha amylases), including the exemplary enzymes of the invention, nucleic acids encoding them, antibodies that bind them, and methods for making and using them. In one aspect, the polypeptides of the invention have an amylase activity, as described herein, including, e.g., the ability to hydrolyze starches into sugars. In one aspect, the polypeptides of the invention have an alpha amylase activity. In alternative aspects, the amylases of the invention have activities that have been modified from those of the exemplary amylases described herein.

The invention includes amylases of the invention with and without signal sequences (including signal sequences of the invention, see e.g., Table 3, below, or other signal sequences) and the signal sequences themselves (e.g., Table 3, below). The invention also include polypeptides (e.g., fusion proteins) comprising a signal sequence of the invention, see, e.g., Table 3, below. The polypeptide comprising a signal sequence of the invention can be an amylase of the invention or another amylase or another enzyme or other polypeptide.

The invention includes immobilized amylases, anti-amylase antibodies and fragments thereof The invention provides methods for inhibiting amylase activity, e.g., using dominant negative mutants or anti-amylase antibodies of the invention. The invention includes heterocomplexes, e.g., fusion proteins, heterodimers, etc., comprising the amylases of the invention.

In one aspect, amylases (e.g., alpha amylases) of the invention hydrolyze internal polysaccharide bonds, e.g., a-1,4- and 1,6-glucosidic bonds in starch to produce smaller molecular weight maltodextrines. In one aspect, this hydrolysis is largely at random. Thus, the invention provides methods for producing smaller molecular weight maltodextrines.

Amylases of the invention can be used in laboratory and industrial settings to hydrolyze starch or any maltodextrine-comprising compound for a variety of purposes. These amylases can be used alone to provide specific hydrolysis or can be combined with other amylases to provide a "cocktail" with a broad spectrum of activity. Exemplary uses include the removal or partial or complete hydrolysis of starch or any maltodextrine-comprising compound from biological, food, animal feed, pharmaceutical or industrial samples.

For example, the amylases of the present invention can be formulated in laundry detergents to aid in the removal of starch-containing stains. In one aspect, the invention provides detergents comprising amylases of the invention, including amylases active under alkaline conditions, and methods of making and using them. These detergent compositions include laundry and dishwashing (e.g., autodishwashing) solutions and application. Amylases of the invention can be used as cleaning agents in any detergent matrices (see industrial applications below). The amylases of the present invention can be used in the initial stages (liquefaction) of starch processing, in wet corn milling, in alcohol production, in the textile industry for starch desizing, in baking applications, in the beverage industry, in oilfields in drilling processes; in inking of recycled paper; and in animal feed.

Amylases of the invention can have an amylase activity under various conditions, e.g., extremes in pH and/or temperature, oxidizing agents, and the like. The invention provides methods leading to alternative amylase preparations with different catalytic efficiencies and stabilities, e.g., towards temperature, oxidizing agents and changing wash conditions. In one aspect, amylase variants can be produced using techniques of site-directed mutagenesis and/or random mutagenesis. In one aspect, directed evolution can be used to produce a great variety of amylase variants with alternative specificities and stability.

The proteins of the invention are also useful as research reagents to identify amylase modulators, e.g., activators or inhibitors of amylase activity. Briefly, test samples (compounds, broths, extracts, and the like) are added to amylase assays to determine their ability to inhibit substrate cleavage. Inhibitors identified in this way can be used in industry and research to reduce or prevent undesired proteolysis. As with amylases, inhibitors can be combined to increase the spectrum of activity.

The invention also provides methods of discovering new amylases using the nucleic acids, polypeptides and antibodies of the invention. In one aspect, lambda phage libraries are screened for expression-based discovery of amylases. In one aspect, the invention uses lambda phage libraries in screening to allow detection of toxic clones; improved access to substrate; reduced need for engineering a host, by-passing the potential for any bias resulting from mass excision of the library; and, faster growth at low clone densities. Screening of lambda phage libraries can be in liquid phase or in solid phase. In one aspect, the invention provides screening in liquid phase. This gives a greater flexibility in assay conditions; additional substrate flexibility, higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174.

The present invention includes amylase enzymes which are non-naturally occurring carbonyl hydrolase variants (e.g., amylase variants) having a different proteolytic activity, stability, substrate specificity, pH profile and/or performance characteristic as compared to the precursor carbonyl hydrolase from which the amino acid sequence of the variant is derived. Specifically, such amylase variants have an amino acid sequence not found in nature, which is derived by substitution of a plurality of amino acid residues of a precursor amylase with different amino acids. The precursor amylase may be a naturally-occurring amylase or a recombinant amylase. The useful amylase variants encompass the substitution of any of the naturally occurring L-amino acids at the designated amino acid residue positions.

Amylase Signal Sequences

The invention provides signal sequences consisting of or comprising a peptide having a sequence comprising residues 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30 or 1 to 31, 1 to 32, 1 to 33, 1 to 34, 1 to 35, 1 to 36, 1 to 37, 1 to 38, or 1 to 39, or longer, of a polypeptide of the invention. For example, the invention provides amylase (e.g., alpha amylase or glucoamylase) signal sequences and nucleic acids encoding these signal sequences, e.g., exemplary peptides of the invention having sequences as set forth in Table 3, SEQ ID NO:7, SEQ ID NO:8, and SEQ ID NO:213 through 257, and polypeptides comprising (or consisting of) sequences as set forth in Table 3, SEQ ID NO:7, SEQ ID NO:8, and SEQ ID NO:213 through 257. The invention also provides amylase signal sequences and nucleic acids encoding these signal sequences, e.g., peptides comprising or consisting of residues 1 to 27 of SEQ ID NO:323 (encoded by SEQ ID NO:322), peptides comprising or consisting of residues 1 to 22 of SEQ ID NO:333 (encoded by SEQ ID NO:332), peptides comprising or consisting of residues 1 to 20 of SEQ ID NO:335 (encoded by SEQ ID NO:334), peptides comprising or consisting of residues 1 to 35 of SEQ ID NO:337 (encoded by SEQ ID NO:336), etc., see Table 3 for, in addition to these signal sequences, additional amylase signal sequences and nucleic acids encoding these signal sequences.

The invention also provides amylase signal sequences and nucleic acids encoding these signal sequences comprising or consisting of residues 1 to 32 or 1 to 33 of SEQ ID NO:441; residues 1 to 27 or 1 to 28 of SEQ ID NO:443; residues 1 to 24 or 1 to 25 of SEQ ID NO:445; residues 1 to 23 or 1 to 24 of SEQ ID NO:449; residues 1 to 49 or 1 to 50 of SEQ ID NO:451; residues 1 to 34 or 1 to 35 of SEQ ID NO:453; residues 1 to 37 or 1 to 38 of SEQ ID NO:455; residues 1 to 26 or 1 to 27 of SEQ ID NO:457; residues 1 to 29 or 1 to 30 of SEQ ID NO:459; residues 1 to 22 or 1 to 23 of SEQ ID NO:466; residues 1 to 19 or 1 to 20 of SEQ ID NO:485; residues 1 to 54 or 1 to 55 of SEQ ID NO:493; residues 1 to 22 to 1 to 23 of SEQ ID NO:499; residues 21 or 1 to 22 of SEQ ID NO:516; residues 1 to 26 or 1 to 27 of SEQ ID NO:518; residues 1 to 20 or 1 to 21 of SEQ ID NO:540; residues 1 to 23 or 1 to 24 of SEQ ID NO:553; residues 1 to 19 or 1 to 20 of SEQ ID NO:559; residues 1 to 33 or 1 to 34 of SEQ ID NO:566.

For example, regarding Table 3, the invention provides peptides comprising or consisting of amino acid residues 1 to 23 (SEQ ID NO:213) of SEQ ID NO:87, etc.

TABLE 3

| SEQ ID NO. | Signal Sequence |
| --- | --- |
| SEQ ID NO: 87 | AA1-23 (SEQ ID NO: 213) |
| SEQ ID NO: 91 | AA1-23 (SEQ ID NO: 214) |
| SEQ ID NO: 93 | AA1-33 (SEQ ID NO: 215) |
| SEQ ID NO: 97 | AA1-31 (SEQ ID NO: 216) |
| SEQ ID NO: 99 | AA1-30 (SEQ ID NO: 217) |
| SEQ ID NO: 103 | AA1-22 (SEQ ID NO: 218) |
| SEQ ID NO: 105 | AA1-33 (SEQ ID NO: 219) |
| SEQ ID NO: 109 | AA1-25 (SEQ ID NO: 220) |
| SEQ ID NO: 111 | AA1-35 (SEQ ID NO: 221) |
| SEQ ID NO: 113 | AA1-28 (SEQ ID NO: 222) |
| SEQ ID NO: 117 | AA1-21 (SEQ ID NO: 223) |
| SEQ ID NO: 119 | AA1-30 (SEQ ID NO: 224) |
| SEQ ID NO: 123 | AA1-35 (SEQ ID NO: 225) |
| SEQ ID NO: 125 | AA1-28 (SEQ ID NO: 226) |
| SEQ ID NO: 127 | AA1-30 (SEQ ID NO: 227) |
| SEQ ID NO: 131 | AA1-30 (SEQ ID NO: 228) |
| SEQ ID NO: 133 | AA1-30 (SEQ ID NO: 229) |
| SEQ ID NO: 137 | AA1-28 (SEQ ID NO: 230) |
| SEQ ID NO: 139 | AA1-23 (SEQ ID NO: 231) |
| SEQ ID NO: 141 | AA1-23 (SEQ ID NO: 232) |
| SEQ ID NO: 143 | AA1-30 (SEQ ID NO: 233) |
| SEQ ID NO: 145 | AA1-27 (SEQ ID NO: 234) |
| SEQ ID NO: 147 | AA1-29 (SEQ ID NO: 235) |
| SEQ ID NO: 149 | AA1-28 (SEQ ID NO: 236) |
| SEQ ID NO: 69 | AA1-27 (SEQ ID NO: 237) |
| SEQ ID NO: 153 | AA1-26 (SEQ ID NO: 238) |
| SEQ ID NO: 155 | AA1-33 (SEQ ID NO: 239) |
| SEQ ID NO: 157 | AA1-25 (SEQ ID NO: 240) |
| SEQ ID NO: 159 | AA1-25 (SEQ ID NO: 241) |
| SEQ ID NO: 161 | AA1-36 (SEQ ID NO: 242) |
| SEQ ID NO: 167 | AA1-36 (SEQ ID NO: 243) |
| SEQ ID NO: 169 | AA1-23 (SEQ ID NO: 244) |
| SEQ ID NO: 173 | AA1-25 (SEQ ID NO: 245) |
| SEQ ID NO: 175 | AA1-22 (SEQ ID NO: 246) |
| SEQ ID NO: 177 | AA1-23 (SEQ ID NO: 247) |
| SEQ ID NO: 179 | AA1-23 (SEQ ID NO: 248) |
| SEQ ID NO: 185 | AA1-25 (SEQ ID NO: 249) |
| SEQ ID NO: 189 | AA1-36 (SEQ ID NO: 250) |
| SEQ ID NO: 191 | AA1-25 (SEQ ID NO: 251) |
| SEQ ID NO: 193 | AA1-25 (SEQ ID NO: 252) |
| SEQ ID NO: 197 | AA1-23 (SEQ ID NO: 253) |
| SEQ ID NO: 199 | AA1-23 (SEQ ID NO: 254) |
| SEQ ID NO: 201 | AA1-30 (SEQ ID NO: 255) |
| SEQ ID NO: 203 | AA1-25 (SEQ ID NO: 256) |
| SEQ ID NO: 205 | AA1-16 (SEQ ID NO: 257) |
| SEQ ID NO: 73 | AA1-16 (SEQ ID NO: 7) |
| SEQ ID NO: 79 | AA1-26 (SEQ ID NO: 8) |
| SEQ ID NO: 322, 323 | Residues 1 through 27 |
| SEQ ID NO: 332, 333 | Residues 1 through 22 |
| SEQ ID NO: 334, 335 | Residues 1 through 20 |

TABLE 3-continued

| SEQ ID NO. | Signal Sequence |
| --- | --- |
| SEQ ID NO: 336, 337 | Residues 1 through 35 |
| SEQ ID NO: 338, 339 | Residues 1 through 50 |
| SEQ ID NO: 342, 343 | Residues 1 through 23 |
| SEQ ID NO: 344, 345 | Residues 1 through 22 |
| SEQ ID NO: 346, 347 | Residues 1 through 21 |
| SEQ ID NO: 350, 351 | Residues 1 through 21 |
| SEQ ID NO: 352, 353 | Residues 1 through 27 |
| SEQ ID NO: 354, 355 | Residues 1 through 24 |
| SEQ ID NO: 358, 359 | Residues 1 through 29 |
| SEQ ID NO: 362, 363 | Residues 1 through 20 |
| SEQ ID NO: 364, 365 | Residues 1 through 29 |
| SEQ ID NO: 366, 367 | Residues 1 through 24 |
| SEQ ID NO: 370, 371 | Residues 1 through 22 |
| SEQ ID NO: 372, 373 | Residues 1 through 25 |
| SEQ ID NO: 374, 375 | Residues 1 through 21 |
| SEQ ID NO: 376, 377 | Residues 1 through 37 |
| SEQ ID NO: 378, 379 | Residues 1 through 27 |
| SEQ ID NO: 380, 381 | Residues 1 through 29 |
| SEQ ID NO: 382, 383 | Residues 1 through 35 |
| SEQ ID NO: 384, 385 | Residues 1 through 37 |
| SEQ ID NO: 386, 387 | Residues 1 through 25 |
| SEQ ID NO: 388, 389 | Residues 1 through 21 |
| SEQ ID NO: 390, 391 | Residues 1 through 58 |
| SEQ ID NO: 394, 395 | Residues 1 through 57 |
| SEQ ID NO: 396, 397 | Residues 1 through 19 |
| SEQ ID NO: 400, 401 | Residues 1 through 19 |
| SEQ ID NO: 402, 403 | Residues 1 through 19 |
| SEQ ID NO: 404, 405 | Residues 1 through 26 |
| SEQ ID NO: 406, 407 | Residues 1 through 21 |
| SEQ ID NO: 408, 409 | Residues 1 through 51 |
| SEQ ID NO: 410, 411 | Residues 1 through 21 |
| SEQ ID NO: 416, 417 | Residues 1 through 24 |
| SEQ ID NO: 418, 419 | Residues 1 through 44 |
| SEQ ID NO: 420, 421 | Residues 1 through 44 |
| SEQ ID NO: 422, 423 | Residues 1 through 27 |
| SEQ ID NO: 424, 425 | Residues 1 through 37 |
| SEQ ID NO: 428, 429 | Residues 1 through 30 |
| SEQ ID NO: 430, 431 | Residues 1 through 33 |
| SEQ ID NO: 432, 433 | Residues 1 through 34 |
| SEQ ID NO: 434, 435 | Residues 1 through 27 |

The amylase signal sequences of the invention can be isolated peptides, or, sequences joined to another amylase or a non-amylase polypeptide, e.g., as a fusion protein. In one aspect, the invention provides polypeptides comprising amylase signal sequences of the invention. In one aspect, polypeptides comprising amylase signal sequences of the invention comprise sequences heterologous to an amylase of the invention (e.g., a fusion protein comprising an amylase signal sequence of the invention and sequences from another amylase or a non-amylase protein). In one aspect, the invention provides amylases of the invention with heterologous signal sequences, e.g., sequences with a yeast signal sequence. For example, an amylase of the invention comprising a heterologous signal sequence in a vectors, e.g., a pPIC series vector (Invitrogen, Carlsbad, Calif.).

In one aspect, the signal sequences of the invention are identified following identification of novel amylase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The signal sequences can vary in length from 13 to 36 amino acid residues. Various methods of recognition of signal sequences are known to those of skill in the art. For example, in one aspect, novel amylase signal peptides are identified by a method referred to as SignalP. SignalP uses a combined neural network which recognizes both signal peptides and their cleavage sites. (Nielsen, et al., "Identification of prokaryotic and eukaryotic signal peptides and prediction of their cleavage sites." Protein Engineering, vol. 10, no. 1, p. 1-6 (1997).

It should be understood that in some aspects amylases of the invention may not have signal sequences. In one aspect, the invention provides the amylases of the invention lacking all or part of a signal sequence, e.g. the signal sequences of the invention (see Table 3, below). In one aspect, the invention provides a nucleic acid sequence encoding a signal sequence from one amylase operably linked to a nucleic acid sequence of a different amylase or, optionally, a signal sequence from a non-amylase protein may be desired. Table 3 shows exemplary signal sequences of the invention.

Amylase Prepro and Signal Sequences and Catalytic Domains

In addition to signal sequences (e.g., signal peptides (SPs)), as discussed above, the invention provides prepro domains and catalytic domains (CDs). The SPs, prepro domains and/or CDs of the invention can be isolated or recombinant peptides or can be part of a fusion protein, e.g., as a heterologous domain in a chimeric protein. The invention provides nucleic acids encoding these catalytic domains (CDs) (e.g., "active sites"), prepro domains and signal sequences (SPs, e.g., a peptide having a sequence comprising/consisting of amino terminal residues of a polypeptide of the invention).

The amylase signal sequences (SPs), catalytic domains (CDs) and/or prepro sequences of the invention can be isolated peptides, or, sequences joined to another amylase or a non-amylase polypeptide, e.g., as a fusion (chimeric) protein. In one aspect, polypeptides comprising amylase signal sequences SPs and/or prepro of the invention comprise sequences heterologous to amylases of the invention (e.g., a fusion protein comprising an SP and/or prepro of the invention and sequences from another amylase or a non-amylase protein). In one aspect, the invention provides amylases of the invention with heterologous CDs, SPs and/or prepro sequences, e.g., sequences with a yeast signal sequence. An amylase of the invention can comprise a heterologous CD, SP and/or prepro in a vector, e.g., a pPIC series vector (Invitrogen, Carlsbad, Calif.).

In one aspect, SPs, CDs, and/or prepro sequences of the invention are identified following identification of novel amylase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. The signal sequences can vary in length from 13 to 45 or more amino acid residues. Various methods of recognition of signal sequences are known to those of skill in the art. For example, in one aspect, novel hydrolase signal peptides are identified by a method referred to as SignalP. SignalP uses a combined neural network which recognizes both signal peptides and their cleavage sites. (Nielsen, et al., "Identification of prokaryotic and eukaryotic signal peptides and prediction of their cleavage sites." Protein Engineering, vol. 10, no. 1, p. 1-6 (1997).

In some aspects, an amylase of the invention may not have SPs and/or prepro sequences, and/or catalytic domains (CDs). In one aspect, the invention provides amylases lacking all or part of an SP, a CD and/or a prepro domain. In one aspect, the invention provides a nucleic acid sequence encoding a signal sequence (SP), a CD and/or prepro from one amylase operably linked to a nucleic acid sequence of a different amylase or, optionally, a signal sequence (SPs), a CD and/or prepro domain from a non-amylase protein may be desired.

The invention also provides isolated or recombinant polypeptides comprising signal sequences (SPs), prepro domain and/or catalytic domains (CDs) of the invention and heterologous sequences. The heterologous sequences are sequences not naturally associated (e.g., to an amylase) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., amylase sequence). Similarly in one aspect, the invention provides isolated or recombinant nucleic acids encoding these polypeptides. Thus, in one aspect, the isolated or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

The polypeptides of the invention include amylases in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include amylases inactive for other reasons, e.g., before "activation" by a post-translational processing event, e.g., an endo- or exo-peptidase or proteinase action, a phosphorylation event, an amidation, a glycosylation or a sulfation, a dimerization event, and the like. Methods for identifying "prepro" domain sequences, CDs, and signal sequences are well known in the art, see, e.g., Van de Ven (1993) Crit. Rev. Oncog. 4(2):115-136. For example, to identify a prepro sequence, the protein is purified from the extracellular space and the N-terminal protein sequence is determined and compared to the unprocessed form.

The polypeptides of the invention include all active forms, including active subsequences, e.g., catalytic domains (CDs) or active sites, of an enzyme of the invention. In one aspect, the invention provides catalytic domains or active sites as set forth below. In one aspect, the invention provides a peptide or polypeptide comprising or consisting of an active site domain as predicted through use of a database such as Pfam (which is a large collection of multiple sequence alignments and hidden Markov models covering many common protein families, The Pfam protein families database, A. Bateman, E. Birney, L. Cerruti, R. Durbin, L. Etwiller, S. R. Eddy, S. Griffiths-Jones, K. L. Howe, M. Marshall, and E. L. L. Sonnhammer, Nucleic Acids Research, 30(1):276-280, 2002) or equivalent.

Hybrid Amylases and Peptide Libraries

In one aspect, the invention provides hybrid amylases and fusion proteins, including peptide libraries, comprising sequences of the invention. The peptide libraries of the invention can be used to isolate peptide modulators (e.g., activators or inhibitors) of targets, such as amylase substrates, receptors, enzymes. The peptide libraries of the invention can be used to identify formal binding partners of targets, such as ligands, e.g., cytokines, hormones and the like.

In one aspect, the fusion proteins of the invention (e.g., the peptide moiety) are conformationally stabilized (relative to linear peptides) to allow a higher binding affinity for targets. The invention provides fusions of amylases of the invention and other peptides, including known and random peptides. They can be fused in such a manner that the structure of the amylases is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of an amylase sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed amylase variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using assays of proteolytic activities. In alternative aspects, amino acid substitutions can be single residues; insertions can be on the order of from about 1 to 20 amino acids, although considerably larger insertions can be done.

Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides amylases where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g.

leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e. amylase activity) although variants can be selected to modify the characteristics of the amylases as needed.

In one aspect, amylases of the invention comprise epitopes or purification tags, signal sequences or other fusion sequences, etc. In one aspect, the amylases of the invention can be fused to a random peptide to form a fusion polypeptide. By "fused" or "operably linked" herein is meant that the random peptide and the amylase are linked together, in such a manner as to minimize the disruption to the stability of the amylase structure, e.g., it retains amylase activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

Screening Methodologies and "On-line" Monitoring Devices

In practicing the methods of the invention, a variety of apparatus and methodologies can be used to in conjunction with the polypeptides and nucleic acids of the invention, e.g., to screen polypeptides for amylase activity, to screen compounds as potential modulators, e.g., activators or inhibitors, of an amylase activity, for antibodies that bind to a polypeptide of the invention, for nucleic acids that hybridize to a nucleic acid of the invention, to screen for cells expressing a polypeptide of the invention and the like.

Capillary Arrays

Capillary arrays, such as the GIGAMATRIX™, Diversa Corporation, San Diego, Calif., can be used to in the methods of the invention. Nucleic acids or polypeptides of the invention can be immobilized to or applied to an array, including capillary arrays. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays provide another system for holding and screening samples. For example, a sample screening apparatus can include a plurality of capillaries formed into an array of adjacent capillaries, wherein each capillary comprises at least one wall defining a lumen for retaining a sample. The apparatus can further include interstitial material disposed between adjacent capillaries in the array, and one or more reference indicia formed within of the interstitial material. A capillary for screening a sample, wherein the capillary is adapted for being bound in an array of capillaries, can include a first wall defining a lumen for retaining the sample, and a second wall formed of a filtering material, for filtering excitation energy provided to the lumen to excite the sample.

A polypeptide or nucleic acid, e.g., a ligand, can be introduced into a first component into at least a portion of a capillary of a capillary array. Each capillary of the capillary array can comprise at least one wall defining a lumen for retaining the first component. An air bubble can be introduced into the capillary behind the first component. A second component can be introduced into the capillary, wherein the second component is separated from the first component by the air bubble. A sample of interest can be introduced as a first liquid labeled with a detectable particle into a capillary of a capillary array, wherein each capillary of the capillary array comprises at least one wall defining a lumen for retaining the first liquid and the detectable particle, and wherein the at least one wall is coated with a binding material for binding the detectable particle to the at least one wall. The method can further include removing the first liquid from the capillary tube, wherein the bound detectable particle is maintained within the capillary, and introducing a second liquid into the capillary tube.

The capillary array can include a plurality of individual capillaries comprising at least one outer wall defining a lumen. The outer wall of the capillary can be one or more walls fused together. Similarly, the wall can define a lumen that is cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. The capillary array can be formed of any number of individual capillaries, for example, a range from 100 to 4,000,000 capillaries. A capillary array can form a micro titer plate having about 100,000 or more individual capillaries bound together.

Arrays, or "Biochips"

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of an amylase gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. "Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

In practicing the methods of the invention, any known array and/or method of making and using arrays can be incorporated in whole or in part, or variations thereof, as described, for example, in U.S. Pat. Nos. 6,277,628; 6,277,489; 6,261,776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20040018642; 20010019827; 20010016322; 20010014449; 20010014448; 20010012537; 20010008765.

Antibodies and Antibody-based Screening Methods

The invention provides isolated or recombinant antibodies that specifically bind to an amylase of the invention. These antibodies can be used to isolate, identify or quantify the amylases of the invention or related polypeptides. These antibodies can be used to isolate other polypeptides within the scope the invention or other related amylases. The antibodies can be designed to bind to an active site of an amylase. Thus, the invention provides methods of inhibiting amylases using the antibodies of the invention.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, NY (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

Polypeptides or peptides can be used to generate antibodies which bind specifically to the polypeptides, e.g., the amylases, of the invention. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of the invention.

In immunoaffinity procedures, the antibody is attached to a solid support, such as a bead or other column matrix. The protein preparation is placed in contact with the antibody under conditions in which the antibody specifically binds to one of the polypeptides of the invention. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays, and Western Blots.

Polyclonal antibodies generated against the polypeptides of the invention can be obtained by direct injection of the polypeptides into an animal or by administering the polypeptides to a non-human animal. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique, the trioma technique, the human B-cell hybridoma technique, and the EBV-hybridoma technique (see, e.g., Cole (1985) in Monoclonal Antibodies and Cancer Therapy, Alan R. Liss, Inc., pp. 77-96).

Techniques described for the production of single chain antibodies (see, e.g., U.S. Pat. No. 4,946,778) can be adapted to produce single chain antibodies to the polypeptides of the invention. Alternatively, transgenic mice may be used to express humanized antibodies to these polypeptides or fragments thereof.

Antibodies generated against the polypeptides of the invention may be used in screening for similar polypeptides (e.g., amylases) from other organisms and samples. In such techniques, polypeptides from the organism are contacted with the antibody and those polypeptides which specifically bind the antibody are detected. Any of the procedures described above may be used to detect antibody binding.

Kits

The invention provides kits comprising the compositions, e.g., nucleic acids, expression cassettes, vectors, cells, transgenic seeds or plants or plant parts, polypeptides (e.g., amylases) and/or antibodies of the invention. The kits also can contain instructional material teaching the methodologies and industrial uses of the invention, as described herein.

Measuring Metabolic Parameters

The methods of the invention provide whole cell evolution, or whole cell engineering, of a cell to develop a new cell strain having a new phenotype, e.g., a new or modified amylase activity, by modifying the genetic composition of the cell. The genetic composition can be modified by addition to the cell of a nucleic acid of the invention. To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic is parameters can be monitored using the amylases of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:
- identity of all pathway substrates, products and intermediary metabolites
- identity of all the chemical reactions interconverting the pathway metabolites, the stoichiometry of the pathway reactions,
- identity of all the enzymes catalyzing the reactions, the enzyme reaction kinetics,
- the regulatory interactions between pathway components, e.g. allosteric interactions, enzyme-enzyme interactions etc,
- intracellular compartmentalization of enzymes or any other supramolecular organization of the enzymes, and,
- the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., an amylase message) or generating new (e.g., amylase) transcripts in a cell. This increased or decreased expression can be traced by testing for the presence of an amylase of the invention or by amylase activity assays. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114: 313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide (e.g., an amylase) or generating new polypeptides in a cell. This increased or decreased expression can be traced by determining the amount of amylase present or by amylase activity assays. Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immuno-fluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Industrial Applications

Detergent Compositions

The invention provides detergent compositions comprising one or more polypeptides of the invention, for example, amylases of the invention, such as alpha amylases, glucoamylases, etc., and methods of making and using these compositions.

The invention incorporates all methods of making and using detergent compositions, see, e.g., U.S. Pat. Nos. 6,413,928; 6,399,561; 6,365,561; 6,380,147. The detergent compositions can be a one and two part aqueous composition, a non-aqueous liquid composition, a cast solid, a granular form, a particulate form, a compressed tablet, a gel and/or a paste and a slurry form. The invention also provides methods capable of a rapid removal of gross food soils, films of food residue and other minor food compositions using these detergent compositions. Amylases of the invention can facilitate the removal of starchy stains by means of catalytic hydrolysis of the starch polysaccharide. Amylases of the invention can be used in dishwashing detergents in textile laundering detergents.

The actual active enzyme content depends upon the method of manufacture of a detergent composition and is not critical, assuming the detergent solution has the desired enzymatic activity. In one aspect, the amount of amylase present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the polypeptides of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Amylases of the present invention can be formulated into powdered and liquid detergents having pH between 4.0 and 12.0 at levels of about 0.01 to about 5% (preferably 0.1% to 0.5%) by weight. These detergent compositions can also include other enzymes such as known proteases, cellulases, lipases or endoglycosidases, as well as builders and stabilizers. The addition of amylases of the invention to conventional cleaning compositions does not create any special use limitation. In other words, any temperature and pH suitable for the detergent is also suitable for the present compositions as long as the pH is within the above range, and the temperature is below the described enzyme's denaturing temperature. In addition, the polypeptides of the invention can be used in a cleaning composition without detergents, again either alone or in combination with builders and stabilizers.

The present invention provides cleaning compositions including detergent compositions for cleaning hard surfaces, detergent compositions for cleaning fabrics, dishwashing compositions, oral cleaning compositions, denture cleaning compositions, and contact lens cleaning solutions.

In one aspect, the invention provides a method for washing an object comprising contacting the object with a polypeptide of the invention under conditions sufficient for washing. In one aspect, a polypeptide of the invention (e.g., an alkaline-active amylase) is used in a detergent, i.e., as a detergent additive. The detergent composition of the invention may, for example, be formulated as a hand or machine laundry detergent composition comprising a polypeptide of the invention. Detergent compositions of the invention include laundry and dishwashing (e.g., autodishwashing) solutions and application. A laundry additive suitable for pre-treatment of stained fabrics can comprise a polypeptide of the invention. A fabric softener composition can comprise a polypeptide of the invention. Alternatively, a polypeptide of the invention can be formulated as a detergent composition for use in general household hard surface cleaning operations. In alternative aspects, detergent additives and detergent compositions of the invention may comprise one or more other enzymes such as a protease, a lipase, a cutinase, another amylase, a carbohydrase, a cellulase, a pectinase, a mannanase, an arabinase, a galactanase, a xylanase, an oxidase, e.g., a lactase, and/or a peroxidase. The properties of the enzyme(s) of the invention are chosen to be compatible with the selected detergent (i.e. pH-optimum, compatibility with other enzymatic and non-enzymatic ingredients, etc.) and the enzyme(s) is present in effective amounts. In one aspect, amylase enzymes of the invention are used to remove malodorous materials from fabrics. Various detergent compositions and methods for making them that can be used in practicing the invention are described in, e.g., U.S. Pat. Nos. 6,333,301; 6,329,333; 6,326,341; 6,297,038; 6,309,871; 6,204,232; 6,197,070; 5,856,164.

Treating Fabrics

The invention provides methods of treating fabrics using one or more polypeptides of the invention. The polypeptides of the invention can be used in any fabric-treating method, which are well known in the art, see, e.g., U.S. Pat. No. 6,077,316. For example, in one aspect, the feel and appearance of a fabric is improved by a method comprising contacting the fabric with an amylase of the invention in a solution. In one aspect, the fabric is treated with the solution under pressure.

In one aspect, the enzymes of the invention are applied during or after the weaving of textiles, or during the desizing stage, or one or more additional fabric processing steps. During the weaving of textiles, the threads are exposed to considerable mechanical strain. Prior to weaving on mechanical looms, warp yarns are often coated with sizing starch or starch derivatives in order to increase their tensile strength and to prevent breaking. The enzymes of the invention can be applied to remove these sizing starch or starch derivatives. After the textiles have been woven, a fabric can proceed to a desizing stage. This can be followed by one or more additional fabric processing steps. Desizing is the act of removing size from textiles. After weaving, the size coating must be removed before further processing the fabric in order to ensure a homogeneous and wash-proof result. The invention provides a method of desizing comprising enzymatic hydrolysis of the size by the action of an enzyme of the invention.

The enzymes of the invention can be used to desize fabrics, including cotton-containing fabrics, as detergent additives, e.g., in aqueous compositions. The invention provides methods for producing a stonewashed look on indigo-dyed denim fabric and garments. For the manufacture of clothes, the fabric can be cut and sewn into clothes or garments, which is afterwards finished. In particular, for the manufacture of denim jeans, different enzymatic finishing methods have been developed. The finishing of denim garment normally is initiated with an enzymatic desizing step, during which garments are subjected to the action of amylolytic enzymes in order to provide softness to the fabric and make the cotton more accessible to the subsequent enzymatic finishing steps. The invention provides methods of finishing denim garments (e.g., a "bio-stoning process"), enzymatic desizing and providing softness to fabrics using the amylases of the invention. The invention provides methods for quickly softening denim garments in a desizing and/or finishing process.

Foods and Food Processing: Liquification of Starch

The enzymes of the invention have numerous applications in food processing industry. The amylases of the invention are used in starch to fructose processing. Starch to fructose processing can consist of four steps: liquefaction of granular starch, saccharification of the liquefied starch into dextrose, purification, and isomerization to fructose.

The invention provides methods of starch liquefaction using the enzymes of the invention. Concentrated suspensions of starch polymer granules are converted into a solution of soluble shorter chain length dextrins of low viscosity. This step is useful for convenient handling with standard equipment and for efficient conversion to glucose or $10^3$ other sugars. In one aspect, the granular starch is liquefied by gelatinizing the granules by raising the temperature of the granular starch to over about 72° C. The heating process instantaneously disrupts the insoluble starch granules to produce a water soluble starch solution. The solubilized starch solution can then be liquefied by an amylase of the invention. Thus, the invention provides enzymatic starch liquefaction processes using an amylase of the invention.

Figure 26:
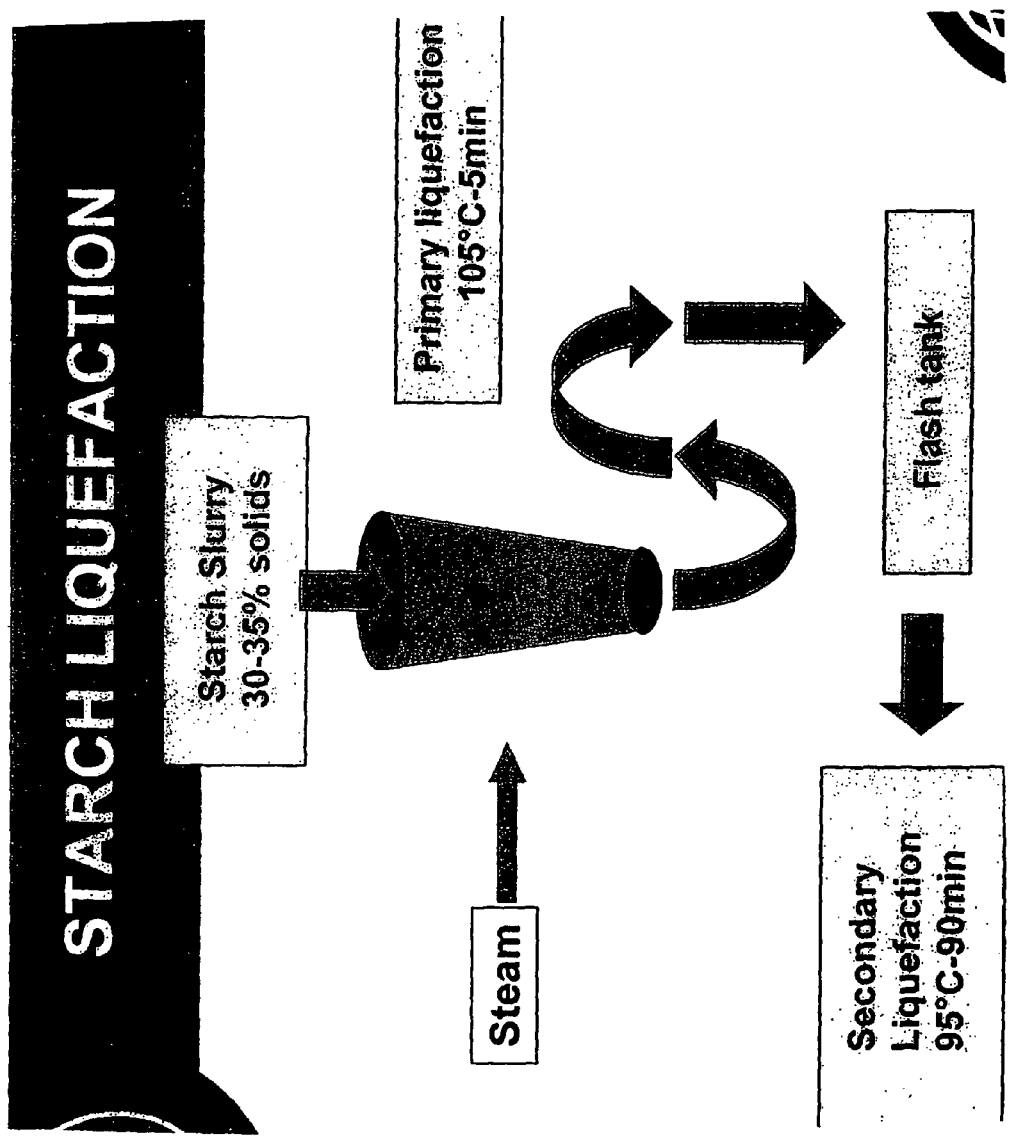
FIG. 26, FIG. 27 and FIG. 28 illustrate alternative exemplary starch processes, including starch liquefaction processes, of the invention (using at least one enzyme of the invention), as described in detail, below.
Figure 27:
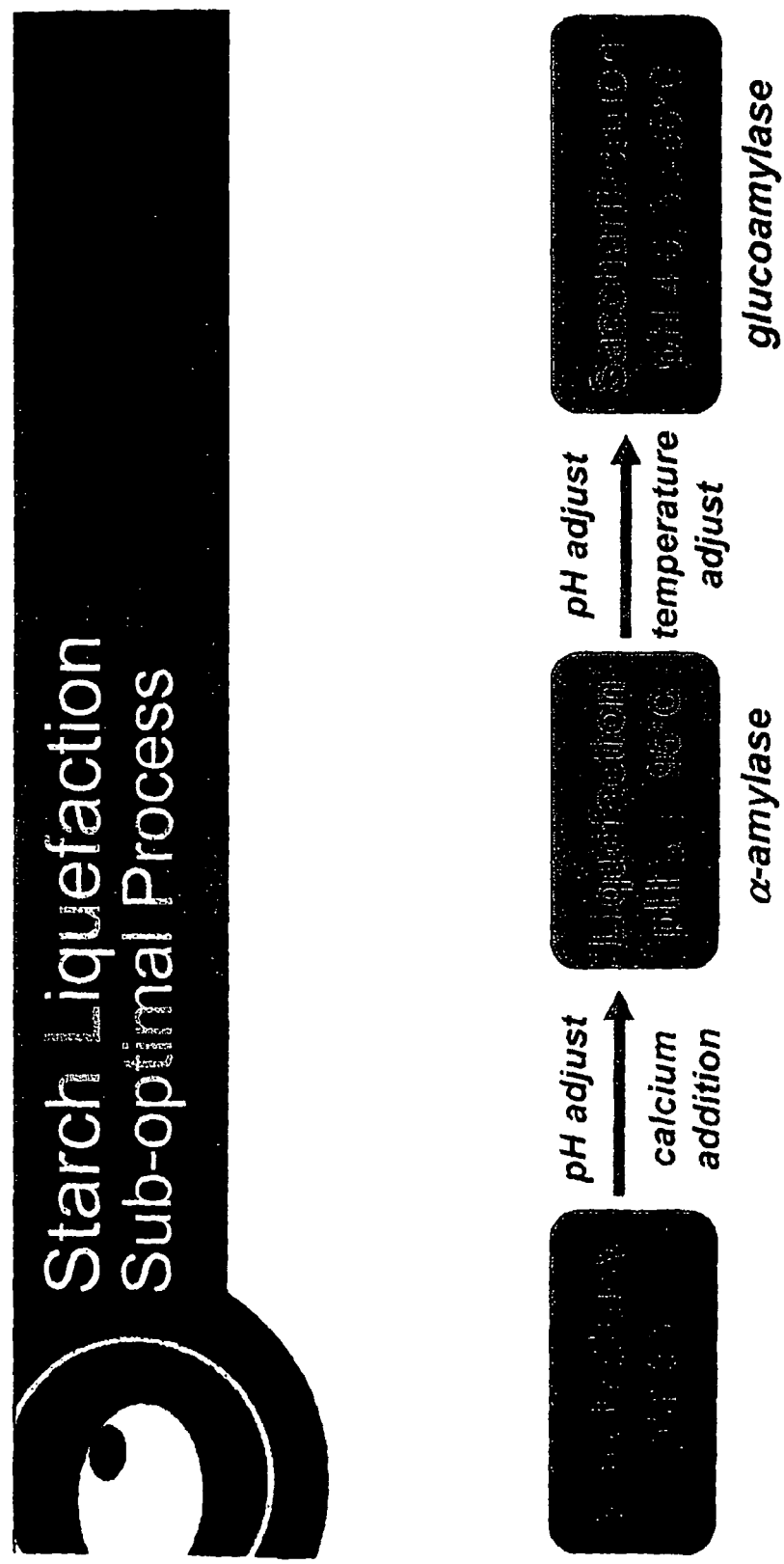
Figure 28:
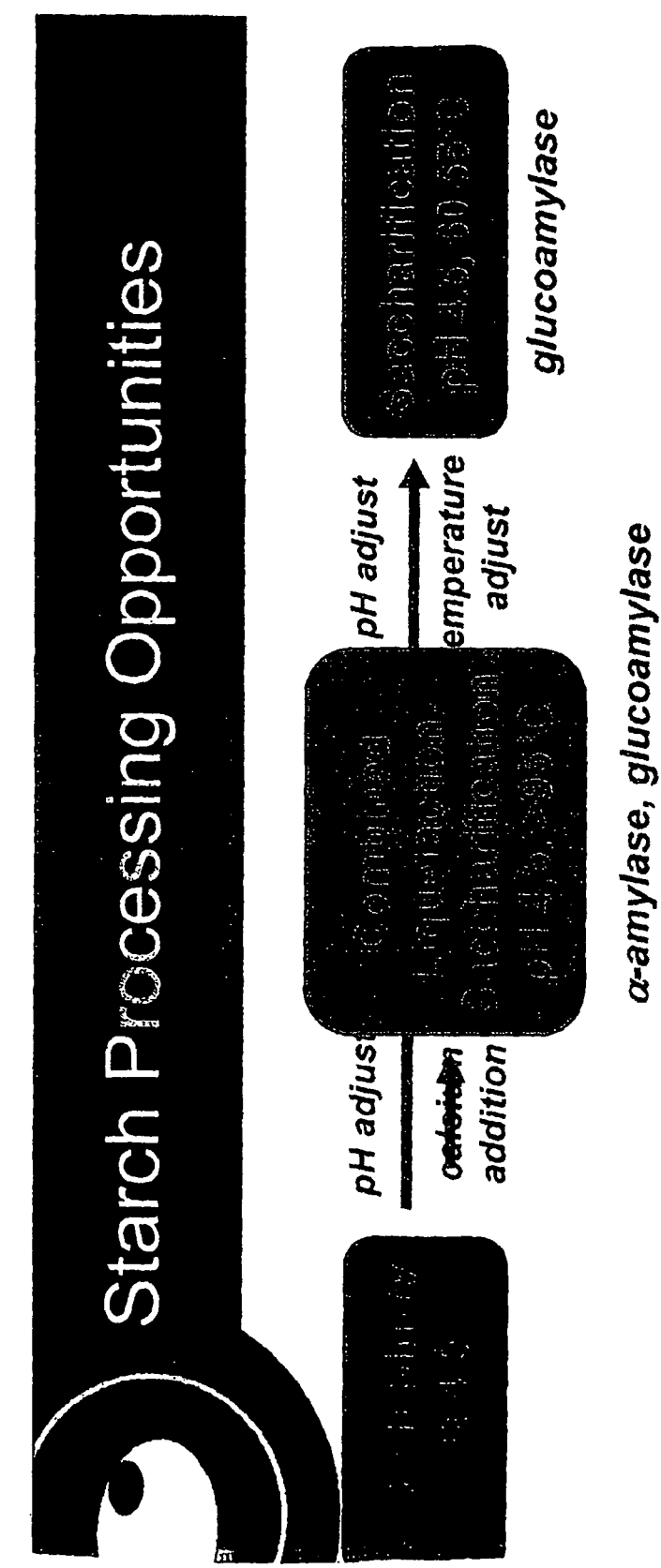
Figure 30:
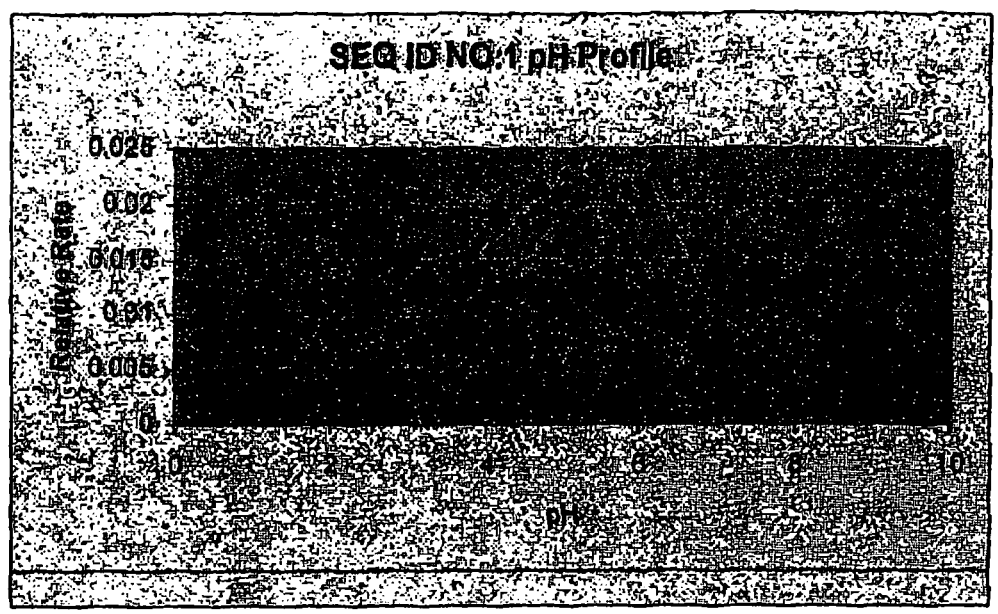
FIG. 30 illustrates a pH activity profile of an exemplary enzyme of the invention (SEQ ID NO:594) in acetate buffer and phosphate buffer to determine the relative rate for the glucoamylase at each pH, as discussed in detail in Example 16, below.
Figure 31:
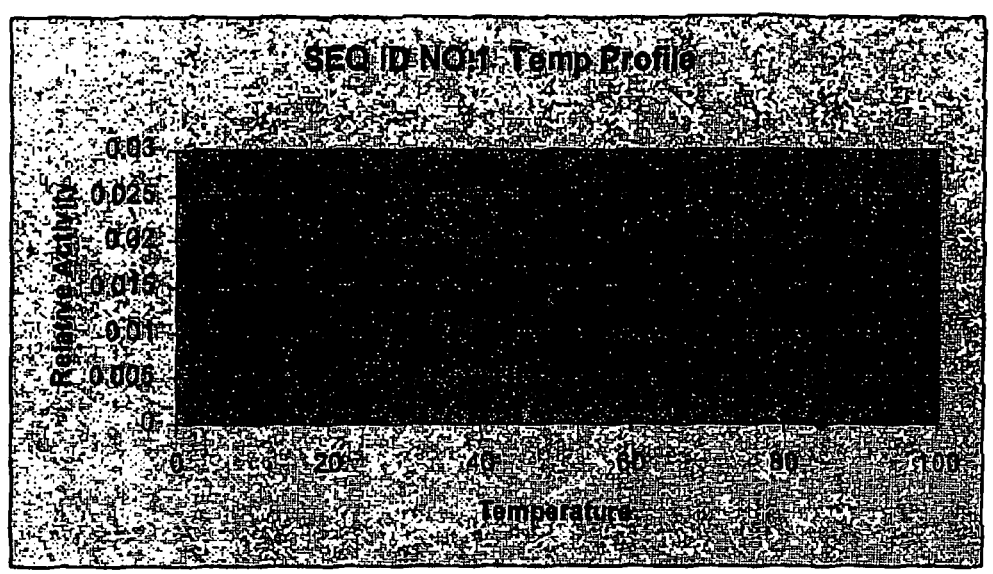
FIG. 31 illustrates a temperature activity profile of an exemplary enzyme of the invention (SEQ ID NO:594) in acetate buffer, as discussed in detail in Example 16, below.
Figure 32:
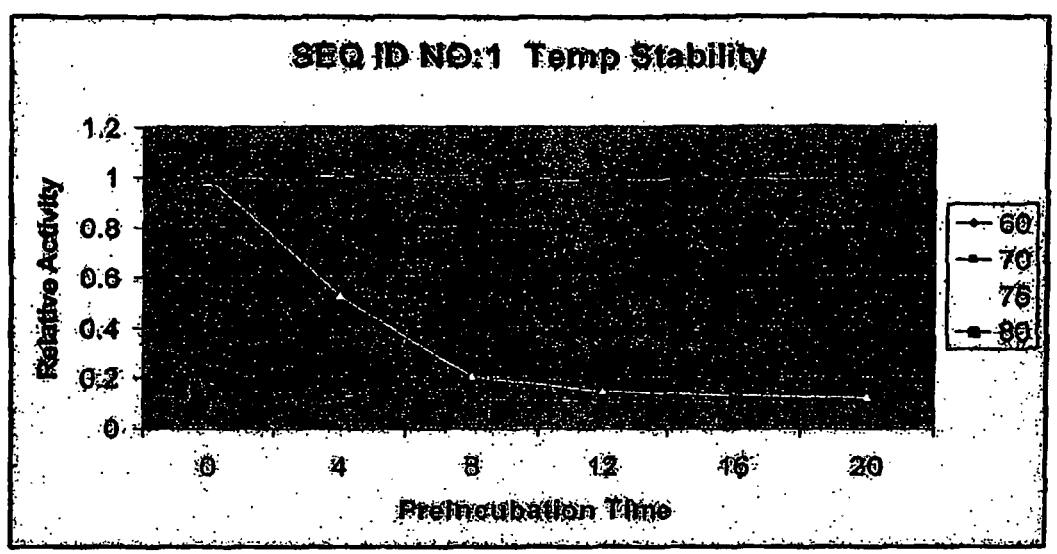
FIG. 32 illustrates a temperature stability profile of an exemplary enzyme of the invention (SEQ ID NO:594), as discussed in detail in Example 16, below.
Figure 33:
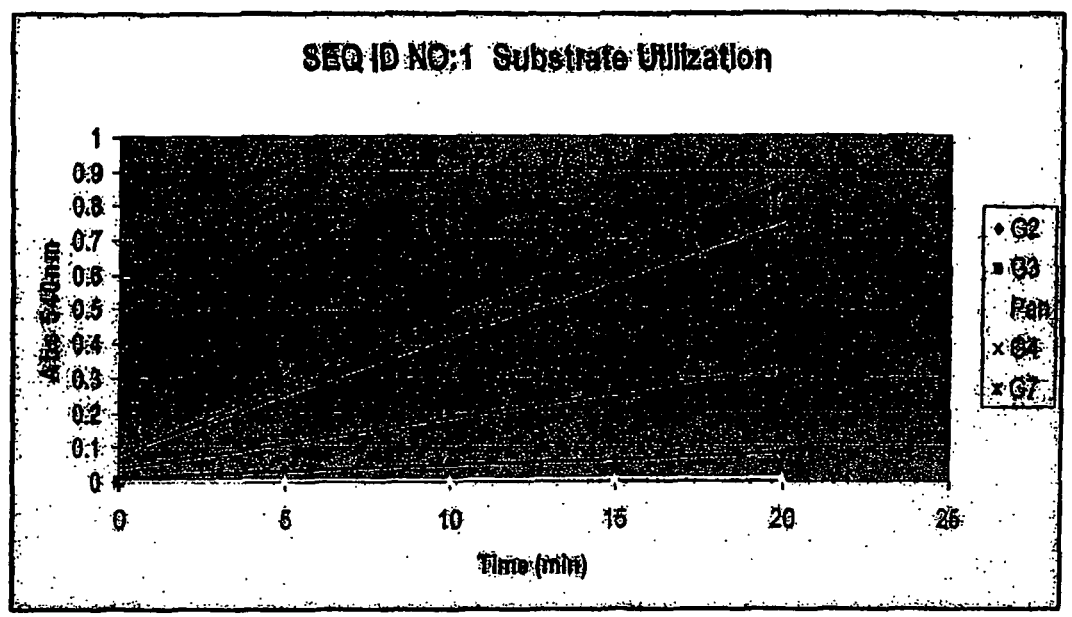
FIG. 33 illustrates a substrate utilization activity profile of an exemplary enzyme of the invention (SEQ ID NO:594) using the dextrins maltose (G2), maltotriose (G3), panose (Pan), maltotetraose (G4), and maltoheptaose (G7), as discussed in detail in Example 16, below.

FIG. 26, FIG. 27 and FIG. 28 illustrate alternative exemplary starch processes, including starch liquefaction processes, of the invention (using at least one enzyme of the invention). For example, FIG. 26 illustrates an exemplary starch liquefaction process of the invention comprising treating a starch slurry (e.g., having about 30% to 35% solids) with steam for primary liquefaction (e.g., at about 105° C. for about 5 minutes), input into a flash tank, followed by secondary liquefaction (e.g., at about 90° C. to 95° C. for about 90 minutes), each or one of these steps involving use of an enzyme of the invention. FIG. 27 illustrates another exemplary starch liquefaction process of the invention comprising treating a starch slurry at about between pH 4 to pH 5, e.g., pH 4.5, adjusting the pH, calcium addition, liquefaction at about pH 5 to pH 6, e.g., pH 5.4, at about 95° C. using an alpha amylase of the invention, followed by another pH and temperature adjustment for saccharification at about between pH 4 to pH 5, e.g., pH 4.5, at a temperature of between about 60° C. to 65° C. using a glucoamylase of the invention. FIG. 28 illustrates another exemplary starch process of the invention comprising treating a starch slurry at about between pH 4 to pH 5, e.g., pH 4.5, (optional adjusting pH, calcium addition), combined liquefaction-saccharification using an alpha amylase and/or a glucoamylase of the invention at about between pH 4 to pH 5, e.g., pH 4.5, at a temperature of greater than about 90° C., or, greater than about 95° C., followed by another pH and temperature adjustment for saccharification at about between pH 4 to pH 5, e.g., pH 4.5, at a temperature of between about 60° C. to 65° C. using a glucoamylase of the invention. In one aspect, the combined liquefaction-saccharification of the invention is a "one-pot" process. In one aspect, the entire process is a "one-pot" process. Any one of these processes, and any one of these steps, can also comprise, or can further comprise, another enzyme of the invention (e.g., a glucosidase such as an a-1,6-glucosidase, a maltase, etc.), or another enzyme such as a pullulanase or an isomerase.

An exemplary enzymatic liquefaction process involves adjusting the pH of a granular starch slurry to between 6.0 and 6.5 and the addition of calcium hydroxide, sodium hydroxide or sodium carbonate. In one aspect, calcium hydroxide is added. This provides calcium ions to stabilize the glucoamylase of the invention against inactivation. In one aspect, upon addition of amylase, the suspension is pumped through a steam jet to instantaneously raise the temperature to between 80°-115° C. In one aspect, the starch is immediately gelatinized and, due to the presence of amylase, depolymerized through random hydrolysis of a-1,4-glycosidic bonds by amylase to a fluid mass. The fluid mass can be easily pumped.

The invention provides various enzymatic starch liquefaction processes using an amylase of the invention. In one aspect of the liquefaction process of the invention, an amylase is added to the starch suspension and the suspension is held at a temperature of between about 80°-100° C. to partially hydrolyze the starch granules. In one aspect, the partially hydrolyzed starch suspension is pumped through a jet at temperatures in excess of about 105° C. to thoroughly gelatinize any remaining granular structure. In one aspect, after cooling the gelatinized starch, a second addition of amylase is made to further hydrolyze the starch.

The invention provides enzymes and processes for hydrolyzing liquid (liquefied) and granular starch. Such starch can be derived from any source, e.g., corn, wheat, milo, sorghum, rye or bulgher. The invention applies to any grain starch source which is useful in liquefaction, e.g., any other grain or vegetable source known to produce starch suitable for liquefaction. The methods of the invention comprise liquefying starch from any natural material, such as rice, germinated rice, corn, barley, milo, wheat, legumes and sweet potato. The liquefying process can substantially hydrolyze the starch to produce a syrup. The temperature range of the liquefaction can be any liquefaction temperature which is known to be effective in liquefying starch. For example, the temperature of the starch can be between about 80° C. to about 115° C., between about 100° C. to about 110° C., and from about 105° C. to about 108° C. In alternative aspects, the amylase used in these methods is active at these temperatures, e.g., active at temperatures in a range of between about 80° C. to about 115° C., between about 100° C. to about 110° C., and from about 105° C. to about 108° C.

Figure 17:
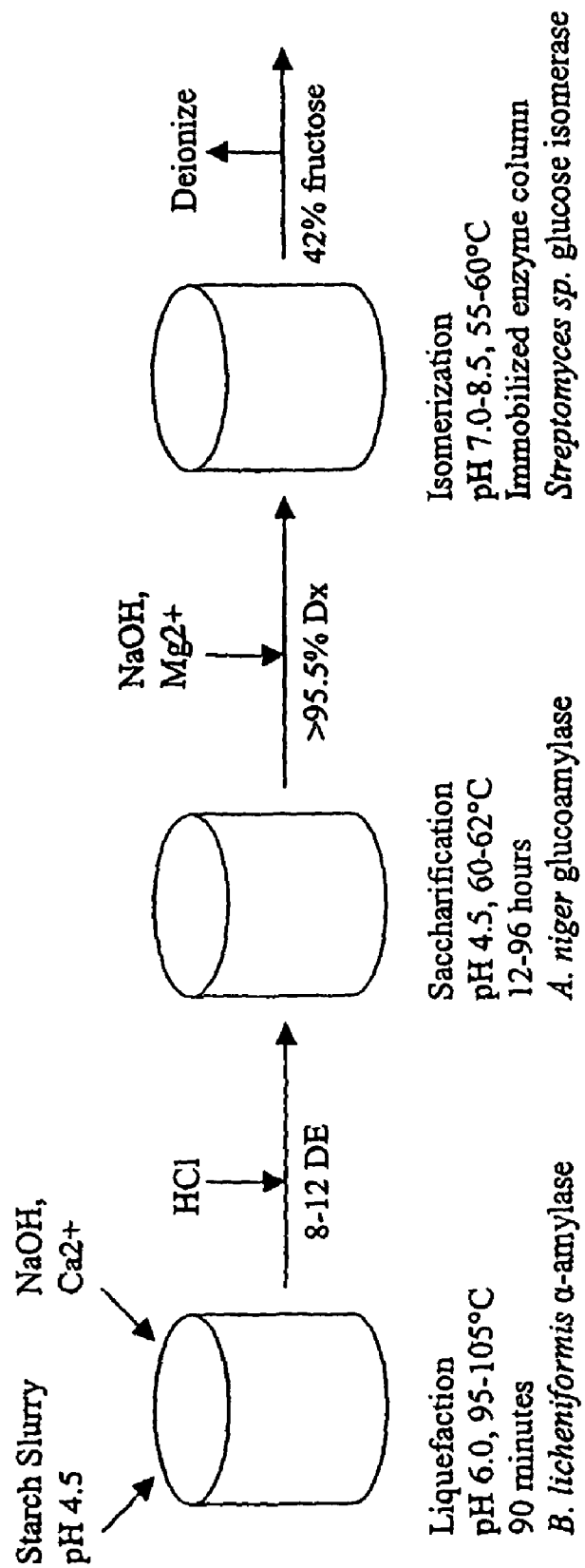
FIG. 17 illustrates methods of the invention for liquefaction saccharification of starch, as described in detail, below.

The invention provides methods for liquefaction saccharification as illustrated in FIG. 17. In one aspect, alpha-amylases of the invention are used in the illustrated liquefaction step (some current industrial methods use $B.$ $licheniformis$ a-amylase). In one aspect, the process takes place at about pH 6.0 at a temperature anywhere in the range of between about 95° C. to 105° C., for a length of time anywhere between about 0.5 and 5 hours, e.g., 60, 90 or 120 minutes. In one aspect, in a corn steep process, prior to liquefaction cellulases, proteases and/or protein thioreductases are added.

In one aspect of a liquefaction process of the invention, an amylase of the invention that has activity at about pH 4.5 (or, anywhere between about pH 5 and pH 5), that may or may not be $Ca^{2+}$ dependent is added. Eliminating the addition of salts in the front end of the process eliminates the need to remove them at the back end of the process. In one aspect of a liquefaction process of the invention, an amylase that is more active is used. This can allow one to decrease the amount of enzyme needed. In one aspect, liquefaction and saccharification are done in the same pot, as a "one-pot process," for example, under conditions comprising about 90° C. to 95° C. (or, anywhere between about 80° C. to 105° C.), as about a 3 hour process (or, as a process lasting between about 1 and 5 hours). In this aspect, the enzyme load can be cut in half again.

In one aspect of a saccharification process of the invention, a glucoamylase of the invention is used. In one aspect, glucoamylases of the invention are used in the illustrated saccharification step (some current industrial methods use $A.$ $niger$ glucoamylase). In one aspect, the process takes place at about pH 4.5, in a temperature range of between about 60° C. to 62° C. (or, anywhere in the range of between about 50° C. to 72° C., or, between about 40° C. to 80° C.) as a process lasting between about 12 and 96 or more hours. In one aspect of a saccharification process of the invention, a glucoamylase of the invention is used to give a higher level of dextrose in the syrup. In one aspect, other enzymes are added, e.g., pullulanases to increase the amount of glucose.

In one aspect, amylases of the invention are used in the illustrated isomerization step (some current industrial methods use $Streptomyces$ sp. glucose isomerase). In one aspect, the isomerization reaction of the invention takes place under conditions comprising anywhere between about pH 5 and pH 10, or anywhere between about ph 6 and pH 9, or anywhere between about pH 7.0 and 8.5. In one aspect, the isomerization reaction of the invention takes place under conditions comprising between about 40° C. to 75° C., or between about 50° C. to 65° C., or between about 55° C. to 60° C.

In one aspect of an isomerization process of the invention, a xylose isomerase is used. In one aspect, cobalt is used in the reaction (some known thermostable glucose isomerases require cobalt). In one aspect, an enzyme of the invention is used that lacks dependency, or has less dependency, on cobalt. In one aspect, an enzyme of the invention is used that has activity at a lower pH, e.g., pH 7.0, pH 6.5, pH 6, pH 5.5, pH 5, pH 4.5, pH 4, pH 3.5 or less, or, e.g., between a range of about pH 3.5 to 7.0). In one aspect, this allows less color formation (otherwise, excess color may have to be removed). In one aspect, the temperature is increased during isomerization, e.g. to between about 80° C. to 110° C., 85° C. to 105° C., or 90° C. to 100° C. This can increase the amount of fructose produced, e.g. to about 51%. However, in one aspect, for sodas (e.g., soft drinks and the like), the fructose level can be anywhere between about 45% and 65%, or 50% and 60%, e.g., about 55%.

In one aspect, one, some or all of the enzymes used in processes of the invention (including the enzymes of the invention) are immobilized, e.g., immobilized on any surface, e.g., a flat surface or an enzyme column, e.g., immobilized on an array, a bead, fiber, pore, capillary and the like. In one aspect, by being immobilized, they can be reused.

In one aspect, the invention provides "enzyme cocktails" using at least one enzyme of the invention. In one aspect, "enzyme cocktails" are used in the processes of the invention, e.g., including the liquefaction saccharification methods as illustrated in FIG. 17. For example, in one aspect, cell wall degrading enzymes (CWDE) are used, e.g., for textile, pulp and paper, and laundry processes of the invention, including, e.g., combinations of cellulases, hemicellulases, xylanase, galactomannanases, glucomannanases, arabinofuranosidases, and others. In one aspect, "enzyme cocktails" used in the processes of the invention for bio-bleaching (e.g., pulp and paper, laundry processes), include combinations of laccases, peroxidases, oxidases and the like. In one aspect, cell wall degrading enzymes are combined with bio-bleaching enzymes and enzymes of the invention to degrade plant cell walls to release color agents.

Processes to Produce High MW Dextrose Syrups

The invention provides processes to produce high MW dextrose syrups using enzymes of the invention, including methods for producing oligosaccharides having a MW tightly groups at about 20,000 MW. In one aspect, amylases of the invention of archael origin, including the archael-derived amylases of SEQ ID NO:80 (encoded by SEQ ID NO:79), SEQ ID NO:82 (encoded by SEQ ID NO:81), SEQ ID NO:116 (encoded by SEQ ID NO:115), SEQ ID NO:323 (encoded by SEQ ID NO:322), SEQ NO: 570 (encoded by SEQ ID NO:169) and enzymes of the invention having the same activity as these archael amylases, are used to liquefy a starch-comprising composition, e.g., a corn starch, to produce an oligosaccharide pattern that is tightly grouped at about 20,000 MW (Bacillus amylases will produce syrups containing much higher MW fragments, and high MW oligosaccharides are not fully converted to glucose by glucoamylases, e.g., Aspergillus glucoamylases, during saccharification).

Using the amylases of the invention of archael origin to catalyze the hydrolysis of a starch-comprising composition, e.g., a corn starch, the approximately 20,000 MW fragments are produced. These approximately 20,000 MW fragments can be rapidly and fully converted to glucose. Thus, in one aspect, saccharified syrups resulting from Bacillus amylase liquefaction contain less dextrose than saccharified syrups from liquefaction using amylases of the invention.

Processes to Produce Homogenous Maltodextrins

The invention provides processes to produce homogenous maltodextrins using enzymes of the invention. The homogenous maltodextrins produced by the methods of the invention can be used in a wide variety of food, drug and coating applications. In one aspect, amylases of the invention of archael origin, including the archael amylases of SEQ ID NO:79, SEQ ID NO:80, SEQ ID NO:81, SEQ ID NO:82, SEQ ID NO:115, SEQ ID NO:116, SEQ ID NO:322, SEQ ID NO:323, and enzymes of the invention having the same activity as these archael amylases, can generate an extremely uniform maltodextrin composition (conventional manufacturing processes using either acid or enzymatic hydrolysis of starch result in a broad, typically bimodal MW distribution of oligosaccharides). The homogenous maltodextrins produced by the methods of the invention have a homogenous MW distribution and can be used in a variety of maltodextrin-comprising products, resulting in lower viscosity, clear (no haze) solutions, better coating properties, better film-forming properties, and the like.

In one aspect, amylases of the invention of archael origin (and enzymes of the invention having the same activity as these archael amylases) are used to liquefy corn starch to produce a uniform maltodextrin-comprising composition. In one aspect, the liquefication is conducted at a pH of between about pH 4.5 to about pH 6.5, e.g., pH 5.0 or 5.5, at temperatures up to about 105° C. The uniform maltodextrin composition can be produced at DE's ranging from about 5 to as high as about 20. The syrups produced by these archael-derived amylases of the invention can be filtered, treated with charcoal and/or spray-dried to yield the maltodextrin-comprising product.

Enzymatic Dry Milling Processes

The invention provides enzymatic dry milling processes using an amylase of the invention. In dry milling, whole grain is ground and combined with water. The germ is optionally removed by flotation separation or equivalent techniques. The resulting mixture, which contains starch, fiber, protein and other components of the grain, is liquefied using amylase. In one aspect, enzymatic liquefaction is done at lower temperatures than the starch liquification processes discussed above. In one aspect, after gelatinization the starch solution is held at an elevated temperature in the presence of amylase until a DE of 10-20 is achieved. In one aspect, this is a period of about 1-3 hours. Dextrose equivalent (DE) is the industry standard for measuring the concentration of total reducing sugars, calculated as D-glucose on a dry weight basis. Unhydrolyzed granular starch has a DE of virtually zero, whereas the DE of D-glucose is defined as 100.

Enzymatic Wet Milling Processes

Figure 25:
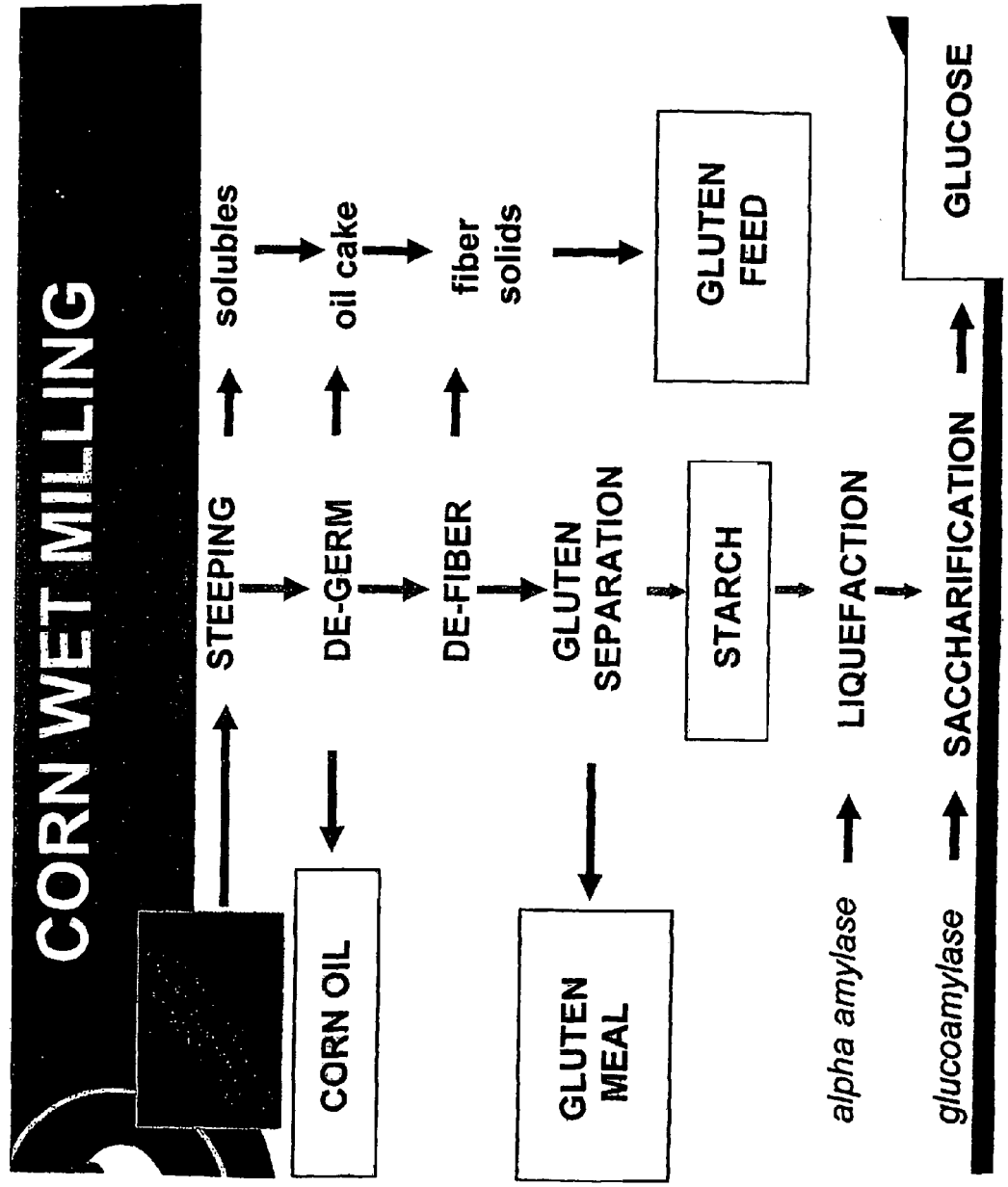
FIG. 25 illustrates an exemplary corn wet milling process of the invention (using at least one enzyme of the invention).

The invention provides wet milling processes, e.g., corn wet milling, using an enzyme, e.g., an amylase, of the invention. Corn wet milling is a process which produces corn oil, gluten meal, gluten feed and starch. Thus, the invention provides methods of making corn oil, gluten meal, gluten feed and starch using an enzyme of the invention. In one aspect, an alkaline-amylase of the invention is used in the liquefaction of starch. In one aspect, a glucoamylase of the invention is used in saccharification to produce glucose. An exemplary corn wet milling process of the invention (using at least one enzyme of the invention) is illustrated in FIG. 25. FIG. 25 illustrates an exemplary corn oil process of the invention comprising steeping, de-germing, de-fibering and gluten separation, followed by liquefaction using an enzyme of the invention (e.g., an alpha amylase), and saccharification using an enzyme of the invention (e.g., glucoamylase).

In one aspect, corn (a kernel that consists of a outer seed coat (fiber), starch, a combination of starch and glucose and the inner germ), is subjected to a four step process, which results in the production of starch. In one aspect, the corn is steeped, de-germed, de-fibered, and the gluten is separated. In a steeping process the solubles are taken out. The product remaining after removal of the solubles is de-germed, resulting in production of corn oil and production of an oil cake, which is added to the solubles from the steeping step. The remaining product is de-fibered and the fiber solids are added to the oil cake/solubles mixture. This mixture of fiber solids, oil cake and solubles forms a gluten feed. After de-fibering, the remaining product is subjected to gluten separation. This separation results in a gluten meal and starch. The starch is then subjected to liquefaction and saccharification using polypeptides of the invention to produce glucose.

FIG. 25 illustrates an exemplary corn wet milling process of the invention (using at least one enzyme of the invention). FIG. 26, FIG. 27 and FIG. 28 illustrate alternative exemplary starch processes, including starch liquefaction processes, of the invention (using at least one enzyme of the invention).

Anti-staling Processes

The invention provides anti-staling processes (e.g., of baked products such as bread) using an amylase of the invention. The invention provides methods to slow the increase of the firmness of the crumb (of the baked product) and a decrease of the elasticity of the crumb using an amylase of the invention. Staling of baked products (such as bread) is more serious as time passes between the moment of preparation of the bread product and the moment of consumption. The term staling is used to describe changes undesirable to the consumer in the properties of the bread product after leaving the oven, such as an increase of the firmness of the crumb, a decrease of the elasticity of the crumb, and changes in the crust, which becomes tough and leathery. The firmness of the bread crumb increases further during storage up to a level, which is considered as negative. Amylases of the invention are used to retard staling of the bread as described e.g., in U.S. Pat. Nos. 6,197,352; 2,615,810 and 3,026,205; Silberstein (1964) Baker's Digest 38:66-72.

In one aspect, an enzyme of the invention is used to retard the staling of baked products while not hydrolyzing starch into the branched dextrins. Branched dextrins are formed by cleaving off the branched chains of the dextrins generated by a-amylase hydrolysis which cannot be degraded further by the a-amylase. This can produce a gummy crumb in the resulting bread. Accordingly, the invention provides a process for retarding the staling of baked products (e.g., leavened baked products) comprising adding an enzyme of the invention comprising exoamylase activity to a flour or a dough used for producing a baked product. Exoamylases of the invention can have glucoamylase, β-amylase (which releases maltose in the beta-configuration) and/or maltogenic amylase activity.

The invention also provides a process for preparing a dough or a baked product prepared from the dough which comprises adding an amylase of the invention to the dough in an amount which is effective to retard the staling of the bread. The invention also provides a dough comprising said amylase and a premix comprising flour together with said amylase. Finally, the invention provides an enzymatic baking additive, which contains said amylase.

The invention also provides a high yield process for producing high quality corn fiber gum by treatment of corn fiber with an enzyme of the invention followed by hydrogen peroxide treatment to obtain an extract of milled corn fiber. See, e.g., U.S. Pat. No. 6,147,206.

Animal Feeds and Additives

The invention provides methods for treating animal feeds and additives using amylase enzymes of the invention. The invention provides animal feeds and additives comprising amylases of the invention. In one aspect, treating animal feeds and additives using amylase enzymes of the invention can help in the availability of starch in the animal feed or additive. This can result in release of readily digestible and easily absorbed sugars.

Use of an amylase of the invention can increase the digestive capacity of animals and birds. Use of an amylase of the invention can ensure availability of an adequate nutrient supply for better growth and performance. In one aspect, the enzymes of the invention can be added as feed additives for animals. In another aspect, the animal feed can be treated with amylases prior to animal consumption. In another aspect, the amylases may be supplied by expressing the enzymes directly in transgenic feed crops (as, e.g., transgenic plants, seeds and the like), such as corn. As discussed above, the invention provides transgenic plants, plant parts and plant cells comprising a nucleic acid sequence encoding a polypeptide of the invention. In one aspect, the nucleic acid is expressed such that the amylase is produced in recoverable quantities. The amylase can be recovered from any plant or plant part. Alternatively, the plant or plant part containing the recombinant polypeptide can be used as such for improving the quality of a food or feed, e.g., improving nutritional value, palatability, and rheological properties, or to destroy an antinutritive factor.

Paper or Pulp Treatment

The enzymes of the invention can be in paper or pulp treatment or paper deinking. For example, in one aspect, the invention provides a paper treatment process using amylases of the invention. In one aspect, the enzymes of the invention can be used to modify starch in the paper thereby converting it into a liquefied form. In another aspect, paper components of recycled photocopied paper during chemical and enzymatic deinking processes. In one aspect, amylases of the invention can be used in combination with cellulases. The paper can be treated by the following three processes: 1) disintegration in the presence of an enzyme of the invention, 2) disintegration with a deinking chemical and an enzyme of the invention, and/or 3) disintegration after soaking with an enzyme of the invention. The recycled paper treated with amylase can have a higher brightness due to removal of toner particles as compared to the paper treated with just cellulase. While the invention is not limited by any particular mechanism, the effect of an amylase of the invention may be due to its behavior as surface-active agents in pulp suspension.

The invention provides methods of treating paper and paper pulp using one or more polypeptides of the invention. The polypeptides of the invention can be used in any paper- or pulp-treating method, which are well known in the art, see, e.g., U.S. Pat. Nos. 6,241,849; 6,066,233; 5,582,681. For example, in one aspect, the invention provides a method for deinking and decolorizing a printed paper containing a dye, comprising pulping a printed paper to obtain a pulp slurry, and dislodging an ink from the pulp slurry in the presence of an enzyme of the invention (other enzymes can also be added). In another aspect, the invention provides a method for enhancing the freeness of pulp, e.g., pulp made from secondary fiber, by adding an enzymatic mixture comprising an enzyme of the invention (can also include other enzymes, e.g., pectinase enzymes) to the pulp and treating under conditions to cause a reaction to produce an enzymatically treated pulp. The freeness of the enzymatically treated pulp is increased from the initial freeness of the secondary fiber pulp without a loss in brightness.

Repulping: Treatment of Lignocellulosic Materials

The invention also provides a method for the treatment of lignocellulosic fibers, wherein the fibers are treated with a polypeptide of the invention, in an amount which is efficient for improving the fiber properties. The amylases of the invention may also be used in the production of lignocellulosic materials such as pulp, paper and cardboard, from starch reinforced waste paper and cardboard, especially where repulping occurs at pH above 7 and where amylases can facilitate the disintegration of the waste material through degradation of the reinforcing starch. The amylases of the invention can be useful in a process for producing a papermaking pulp from starch-coated printed paper. The process may be performed as described in, e.g., WO 95/14807.

An exemplary process comprises disintegrating the paper to produce a pulp, treating with a starch-degrading enzyme before, during or after the disintegrating, and separating ink particles from the pulp after disintegrating and enzyme treatment. See also U.S. Pat. No. 6,309,871 and other US patents cited herein. Thus, the invention includes a method for enzymatic deinking of recycled paper pulp, wherein the polypeptide is applied in an amount which is efficient for effective de-inking of the fiber surface.

Waste Treatment

The enzymes of the invention can be used in a variety of other industrial applications, e.g., in waste treatment. For example, in one aspect, the invention provides a solid waste digestion process using enzymes of the invention. The methods can comprise reducing the mass and volume of substantially untreated solid waste. Solid waste can be treated with an enzymatic digestive process in the presence of an enzymatic solution (including an enzyme of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

Oral Care Products

The invention provides oral care product comprising an amylase of the invention. Exemplary oral care products include toothpastes, dental creams, gels or tooth powders, odontics, mouth washes, pre- or post brushing rinse formulations, chewing gums, lozenges, or candy. See, e.g., U.S. Pat. No. 6,264,925.

Brewing and Fermenting

The invention provides methods of brewing (e.g., fermenting) beer comprising an amylase of the invention. In one exemplary process, starch-containing raw materials are disintegrated and processed to form a malt. An amylase of the invention is used at any point in the fermentation process. For example, amylases of the invention can be used in the processing of barley malt. The major raw material of beer brewing is barley malt. This can be a three stage process. First, the barley grain can be steeped to increase water content, e.g., to around about 40%. Second, the grain can be germinated by incubation at 15-25° C. for 3 to 6 days when enzyme synthesis is stimulated under the control of gibberellins. During this time amylase levels rise significantly. In one aspect, amylases of the invention are added at this (or any other) stage of the process. The action of the amylase results in an increase in fermentable reducing sugars. This can be expressed as the diastatic power, DP, which can rise from around 80 to 190 in 5 days at 12° C.

Amylases of the invention can be used in any beer producing process, as described, e.g., in U.S. Pat. Nos. 5,762,991; 5,536,650; 5,405,624; 5,021,246; 4,788,066.

Use in Drilling Well and Mining Operations

The invention also includes methods using enzymes of the invention in well and drilling operations, e.g., gas, oil or other drilling or mining operations. For example, in one aspect, enzymes of the invention are used to increase the flow of production fluids from a subterranean formation, e.g., a well or a mine. In one aspect, the enzymes of the invention are used to remove viscous, starch-containing fluids that can be damaging, e.g., fluids formed during production operations. These starch-containing fluids can be found within a subterranean formation which surrounds a completed well bore. In one aspect, an amylase of the invention is used in an oil well drilling fluid to aid in the carrying away of drilling mud.

In one aspect, the method comprises allowing production fluids (comprising enzymes of the invention) to flow from the well bore or a mine. The methods can comprise reducing the flow of production fluids from the formation below expected flow rates and formulating an enzyme treatment by blending together an aqueous fluid and a polypeptide of the invention. The methods can comprise pumping the enzyme treatment to a desired location within the well bore or other drilled shaft and allowing the enzyme treatment to degrade the viscous, starch-containing, damaging fluid. The methods can comprise removing the fluid from the subterranean formation to the well or shaft surface. In one aspect, the enzyme treatment is effective to attack the alpha glucosidic linkages in the starch-containing fluid. In one aspect, amylases of the invention are used in mine drilling, well drilling (e.g., gas or oil well drilling), and the like to carry away drilling mud, e.g., while drilling the hole (well bore or shaft).

The enzymes of the invention can be used in any well, shaft or mine drilling operation, many of which are well known in the art. For example, the invention provides methods of introducing an enzyme of the invention, which in one aspect can also comprise an oil or gas field production chemical, into a rock formation comprising oil and/or gas, which comprises passing a microemulsion comprising the enzyme (and, in one aspect, the chemical) down a production well and then into the formation. In one aspect, a production well is subjected to a "shut-in" treatment whereby an aqueous composition comprising an enzyme of the invention is injected into the production well under pressure and "squeezed" into the formation and held there. See, e.g., U.S. Pat. No. 6,581,687.

In one aspect, the amylases of the invention used in gas, oil or other drilling or mining operations are active at high or low pH and/or high or low temperatures, e.g., amylases of the invention used in these processes are active under conditions comprising about pH 6.5, pH 6, pH 5.5, pH 5, pH 4.5 or pH 4, or lower, or, under conditions comprising about pH 7, pH 7.5 pH 8.0, pH 8.5, pH 9, pH 9.5, pH 10, pH 10.5 or pH 11 or higher. In one aspect, the amylases of the invention used in these processes are active under conditions comprising a temperature range of anywhere between about 0° C. to about 37° C., or, between about 37° C. to about 95° C. or more, or, between about 80° C. to about 120° C., e.g., 85° C., 90° C., 95° C., 98° C., 100° C., 105° C., 110° C., 115° C., 120° C. or more.

Delayed Release Compositions

The invention provides delayed release or "controlled release" compositions comprising a desired composition coated by a latex polymer, e.g., a latex paint, or equivalent. The delayed release/controlled release compositions of the invention can comprise any desired composition, including enzymes or any active ingredient, including small molecules, drugs, polysaccharides, lipids, nucleic acids, vitamins, antibiotics, insecticides, and the like. In one aspect, the coating will not readily dissolve at a relatively low temperature but will decompose to release the desired composition (e.g., enzyme) at a relatively higher temperature.

The invention provides methods for the delayed release/controlled release of compositions wherein the composition is coated by a latex polymer, e.g., a latex paint, or equivalent.

The delayed release/controlled release compositions and methods of the invention can be used for a variety of medical and industrial applications, for example, in one aspect, delayed release/controlled release enzyme compositions of the invention comprise enzymes involved in guar fracturing fluids in enhanced oil recovery operations. The oilfield guar degrading application of the invention is facilitated by a coating that will not readily dissolve at low temperature but will decompose to release the enzyme at higher temperatures.

In another aspect, the delayed release/controlled release enzyme compositions of the invention comprise animal feeds or nutritional supplements comprising, e.g., enzymes, vitamins, antibiotics and/or other food, drug or nutritional supplements. These active compounds in the animal feeds or nutritional supplements are protected from pelleting conditions or gastric digestion by the coating on a delayed release/controlled release composition of the invention.

In one aspect, the release is a temperature activated release, e.g., the desired composition (e.g., enzyme) is released at an elevated temperature, e.g., between about 37° C. to about 95° C. or more, e.g., 85° C., 90° C., 95° C., 98° C., 100° C. or more. The rate of release can be controlled by the thickness or amount of "barrier" or latex polymer, applied to the desired composition, e.g., a pellet or matrix comprising the desired composition. Thus, the invention provides pellets or matrices having a range of thicknesses of latex polymer or equivalent and methods of using them.

The invention provides delayed release/controlled release enzyme compositions, e.g., in one aspect, comprising an enzyme of the invention. In one aspect, the invention provides an enzyme (e.g., an enzyme of the invention), or a pelleted composition comprising an enzyme (e.g., an enzyme of the invention), coated with a latex polymer, e.g., a latex paint, or equivalent. In one aspect, the invention provides methods of making delayed release enzyme compositions comprising coating an enzyme (e.g., an enzyme of the invention), or a pelleted composition comprising an enzyme (e.g., an enzyme of the invention), with a latex polymer, e.g., a latex paint, or equivalent. In one aspect, the invention provides methods of making delayed release/controlled release compositions comprising coating a desired compound with a latex polymer, e.g., a latex paint, or equivalent.

Latex polymers that are used in the delayed release/controlled release compositions (e.g., delayed release/controlled release enzyme compositions) and methods of the invention include, but are not limited to, various types such as the following: acrylics; alkyds; celluloses; coumarone-indenes; epoxys; esters; hydrocarbons; maleics; melamines; natural resins; oleo resins; phenolics; polyamides; polyesters; rosins; silicones; styrenes; terpenes; ureas; urethanes; vinyls; and the like. Latex polymers that are used in the delayed release compositions and methods of the invention also include, but are not limited to, one or more homo- or copolymers containing one or more of the following monomers: (meth)acrylates; vinyl acetate; styrene; ethylene; vinyl chloride; butadiene; vinylidene chloride; vinyl versatate; vinyl propionate; t-butyl acrylate; acrylonitrile; neoprene; maleates; fumarates; and the like, including plasticized or other derivatives thereof.

The amount of latex polymer used in the latex composition of the invention is not critical, but may be any amount following well established procedures using latex polymers. In alternative aspects, the amount of dry latex polymer is at least about 1, or, from about 2 to about 50, or, from about 3 to about 40 weight percent of the total latex composition. The latex composition of the invention may optionally contain other components such as those generally used in latex compositions. These additional components include, but are not limited to, one or more of the following: solvents such as aliphatic or aromatic hydrocarbons, alcohols, esters, ketones, glycols, glycol ethers, nitroparaffins or the like; pigments; fillers, dryers; flatting agents; plasticizers; stabilizers; dispersants; surfactants; viscosifiers including polymeric associative thickeners, polysaccharide-based thickeners and so on; suspension agents; flow control agents; defoamers; anti-skinning agents; preservatives; extenders; filming aids; crosslinkers; surface improvers; corrosion inhibitors; and other ingredients useful in latex compositions. In one aspect, latex compositions of the invention having improved rheology and stability are provided by combining the latex polymer and a polysaccharide with water following established procedures. See, e.g., U.S. Pat. Nos. 6,372,901; 5,610,225.

In one aspect, in making a pelleted or matrix-comprising composition of the invention comprising an active composition, e.g., an enzyme (e.g., an enzyme of the invention), coated with a latex polymer, e.g., a latex paint, or equivalent, the active composition (e.g., enzyme) is embedded in the body of the pellet (in one aspect, a majority, or all, of the active composition (e.g., enzyme) is embedded in the pellet. Thus, harsh chemicals, e.g., the latex coating, which may be an inactivator of the desired, active ingredient, can be used to coat the surface of the pellet or matrix. The composition of the coating can be broken down by agents such as heat, acid, base, pressure, enzymes, other chemicals and the like, to have a controlled release of the desired enzymatic activity triggered by the exposure to the coating-degrading agent.

In one aspect, an active composition, e.g., an enzyme (e.g., an enzyme of the invention, or another enzyme, e.g., a mannanase), is dispersed in a corn term meal and/or a corn starch matrix (e.g., as a pellet). This mixture (e.g., pellet) disintegrates within ten minutes in room temperature (e.g., about 22° C.) water to release all (100%) of the active composition, e.g., releases all of the enzymatic activity. At higher temperatures, the rate of release increases. This is not an acceptable rate of disintegration for many uses.

However, as a delayed release/controlled release composition of the invention, i.e., when this mixture is coated with a latex polymer, e.g., a latex paint, or equivalent, the disintegration of the mixture (e.g., pellet, matrix) is delayed. The rate and extent of release can be controlled by the thickness of the coating (barrier) applied to the pellet or matrix. For example, a coated particle will release only 30% of the activity after six hours in 22° C. water. At 60° C., 50% of the enzyme is released in 90 minutes. At 80° C., 80% of the enzyme is released during one hour.

The invention will be further described with reference to the following examples; however, it is to be understood that the invention is not limited to such examples.

EXAMPLES

Example 1

Identification and Characterization of Thermostable α-Amylases

The following example describes an exemplary method for determining if a polypeptide is within the scope of the invention. This example describes the identification of novel acid amylases of the invention. The screening program was carried out under neutral and low pH conditions. DNA libraries generated from low pH samples were targeted for discovery. This effort afforded the discovery of hundreds of clones having the ability to degrade starch. DNA sequence and bioinformatic analyses classified many of these genes as previously unidentified amylases.

Biochemical Studies

Figure 5:
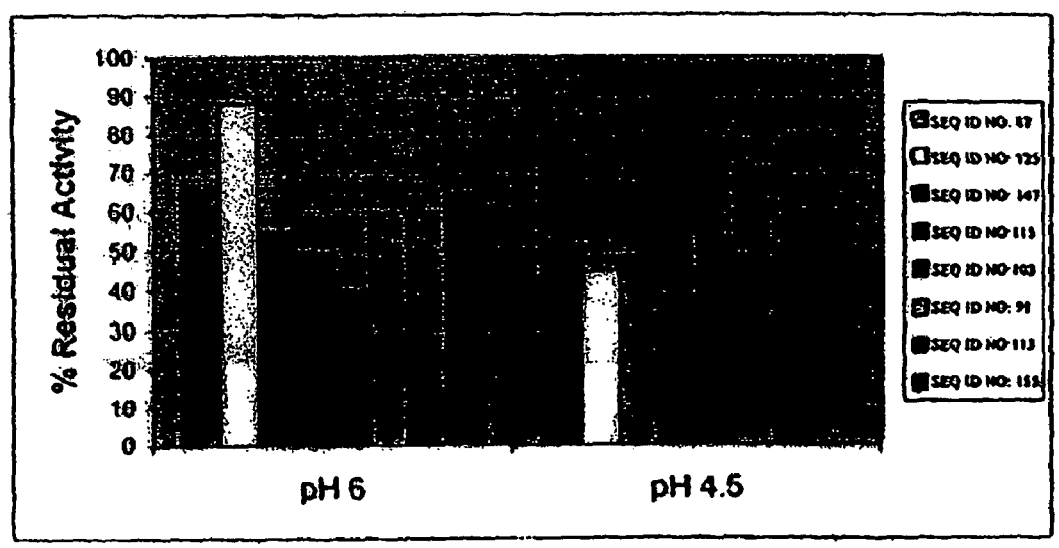
FIG. 5 is a graph showing the Residual activity of various amylases following heating to 90° C. for 10 min in Example 1.

Biochemical analysis of the amylase genomic clones showed that many had pH optima of less than pH 6. Lysates of these genomic clones were tested for thermal tolerance by incubation at 70° C., 80° C., 90° C. or 100° C. for 10 minutes and measurement of residual activity at pH 4.5. Those clones retaining >50% activity after heat treatment at 80° C. were chosen for further analysis. These clones were incubated at 90° C. for 10 minutes at pH 6.0 and 4.5 and tested for residual activity at pH 4.5 (FIG. 5). A number of clones retained >40% of their activity following this treatment. For comparative purposes, residual activity of an enzyme of the invention (an "evolved" amylase), SEQ ID NO:437 (encoded by SEQ ID NO:436), was equivalent to the best of the second-generation enzymes; the specific activity of SEQ ID NO:437 was greater.

Thermal activity of the clones with residual activity after heat treatment at 90° C. at pH 4.5 was measured at room temperature, 70° C. and 90° C. at pH 4.5. Table 1 shows that the hydrolysis rates of SEQ ID NO: 87 (*B. stearothermophilus* amylase) and SEQ ID NO. 113 (*B. licheniformis* amylase) decrease at higher temperatures, whereas the rate for SEQ ID NO:125 continues to increase as the temperature is raised to 70° C. and only reduces by around 50% at 90° C.

The exemplary polypeptide having a sequence as set forth in SEQ ID NO:437 (encoded by SEQ ID NO:436) is thermostable, retaining 50% activity after 25 minutes at 100° C. in the absence of added calcium, at pH 4.5. This exemplary polypeptide retained 90% activity after 60 minutes at 100° C. in the presence of 40 mg/L calcium, pH 4.5. The activity profile of the polypeptide SEQ ID NO:437 is in the range of between about 4.8 and 5.0. Added calcium is not required for activity.

The polypeptide SEQ ID NO:437 can have a light brown to yellow liquid with a specific gravity of 1.1, at pH 10, when formulated with 35% glycerol. Its alpha amylase activity is between about 110 to 115 IAU*/gram (*IAU=INNOVASE™ activity unit). One analytical method used comprised hydrolysis of 4-nitrophenyl-alpha-D-hexa-glucopyranoside (this same method can be used to determine if an enzyme is within the scope of the invention).

Candidate Evaluation

Based on residual activity at pH 4.5 after a 90° C. heat treatment, specific activity and rate of starch hydrolysis at 90° C. when compared with *B. licheniformis* amylase, SEQ ID NO:125 is compared with the enzyme (an "evolved" amylase) of SEQ ID NO:437 in a starch liquefaction assay.

TABLE 1

|  | Room temperature | 70° C. | 90° C. |
|---|---|---|---|
| SEQ ID NO.: 87[1] | 1.25 | 1.43 | 0.33 |
| SEQ ID NO.: 113[2] | 3.3 | 1.9 | 0.39 |
| SEQ ID NO.: 125 | 1.9 | 47 | 19 |

Table 1 shows rates of dye labeled starch hydrolysis (relative fluorescence units/s) of three genomic clones at pH 4.5 and 3 different temperatures.
[1]*B. stearothermophilis* amylase,
[2]*B. licheniformis* amylase.

The following table is a summary of Average Relative Activity (ARA), Thermal Tolerance, Thermal Stability, Specific Activity and Expression (Units/L) for selected exemplary enzymes of the invention (for example, SEQ ID NOS: 125, 126, refers to a polypeptide having a sequence as set forth in SEQ ID NO:126, encoded by SEQ ID NO:125, etc.):

| Enzyme | Expression Host | Average Relative Activity (ARA) | pH Optimum | Thermal Tolerance % RA after 5 min** 50, 60, 70, 80, 90° C. | Thermal Stability % RA 37, 65, 80° C. | Specific Activity (U/mg at pH 5.3, 37° C.) | Expression (Units/L) |
|---|---|---|---|---|---|---|---|
| Benchmark SEQ ID NOS: |  | 80 | 4.0 to 5.5 | 105, 107, 88, 58, 27 | 100, 83, 0 | 82 |  |
| 125, 126 | *Pichia* | 66 | 4.5 to 6.0 | 86, 88, 100, 86, 65 | 100, 347, 553 | 81 | 8521 |
| 378, 379 | *Pichia* | 66 | 6.0 to 7.0 | 22, 0, 0, 0, 0 |  | 937 | 183615 |
| 416, 417 | *Pichia* | 59 | 4.5 to 5.0 | 56, 1, 1, 0, 1 |  | 39 | 23256 |
| 203, 204 | *Pichia* | 61 | 6.0 to 7.0 | 18, 2, 3, 2, 3 |  | 20 | 122107 |
| 434, 435 | *Pichia* | 76 | 6.0 to 6.5 | 151, 58, 0, 0, 0 |  | 151 | 17171 |
| 420, 421 | *Pichia* | 84 | 5.5 to 7.0 | 68, 26, 0, 0, 0 |  | 75 | 5005 |
| 350, 351 | *Pichia* | 59 | 6.0 to 7.0 | 6, 0, 0, 0, 0 |  | 104 | 39662 |
| 402, 403 | *Pichia* | 67 | 5.5 to 6.0 | 42, 8, 11, 12, 16 |  | 535 | 75053 |
| 336, 337 | *Pichia* | 63 | 4.5 to 5.5 | 124, 105, 115, 108, 117 | 100, 0, 0 | 572 | 20822 |
| 430, 431 | *Pichia* | 50 | 6.0 to 6.5 | 111, 86, 82, 89, 35 |  | 138 | 6556 |

-continued

| Enzyme | Expression Host | Average Relative Activity (ARA) | pH Optimum | Thermal Tolerance % RA after 5 min** 50, 60, 70, 80, 90° C. | Thermal Stability % RA 37, 65, 80° C. | Specific Activity (U/mg at pH 5.3, 37° C.) | Expression (Units/L) |
|---|---|---|---|---|---|---|---|
| 127, 128 | Pichia | 71 | 5.5 to 6.5 | 127, 115, 53, 4, 5 | | 17 | 114999 |
| 101, 102 | Pichia | 63 | 5.0 to 5.5 | 124, 164, 145, 120, 144 | | 28 | 11559 |
| 388, 389 | Pichia | 80 | 6.0 to 7.0 | 87, 29, 5, 0, 0 | | 259 | 163163 |
| 539, 540 | Pichia | TBD | 4.0 to 4.5 | 102, 100, 31, 12, 3 | 100, 186, 123 | TBD | TBD |

A.R.A. is Average Relative Activity. A.R.A. is calculated as the average relative activity of an amylase between pH 4 and pH 7.5.
Approximate units per liter expression is calculated as follows: (total units of amylase present in recovered lyophilized powder) (volume of culture in fermenter)

Evaluation of the Amylase SEQ ID NO:437

The amylase SEQ ID NO:437 (encoded by SEQ ID NO:436) was evaluated under a variety of conditions. In the following protocols N°2 yellow dent corn was used as a starch source.

Liquefaction

A starch slurry comprising 35% dry solids ("DS") was subjected to primary liquefaction for five minutes under various temperatures in the range of 95° C. to 119° C. (e.g., at about 110° C.), with an enzyme concentration of between 0.2 to 0.8 gram/kilogram (g/kg) starch DS, with added calcium in the range of between zero and 30 parts per million (ppm), at pH 4.0 to pH 5.6. Secondary liquefaction comprised conditions of 120 minutes at 95° C.

Saccharification

Saccharification was initially tested using 35% dry solids ("DS") (starch slurry) and glucoamylase AMG 300 L (Novozymes A/S, Denmark) at 0.225 AGU/gram DS (AGU=amyloglucosidase, or glucoamylase, units), pH 4.3, at 60° C. for 44 hours.

The amylase SEQ ID NO:437 was demonstrated to be useful under the above-described pH conditions, was calcium independent and had a high thermal stability. In one aspect, amylase SEQ ID NO:437, or another amylase of the invention, is used in a dosage range of between 0.5 to 0.7 kg/MT DS starch.

The invention provides methods for making nutritive sweeteners using enzymes of the invention, e.g., processes comprising the above described liquefaction and saccharification protocols using, e.g., amylase SEQ ID NO:437, or another enzyme of the invention. In one aspect, the dosage range for an enzyme of the invention in these processes is between about 0.5 to 0.7 gram per kg starch DS, a jet temperature (e.g., using a jet cooker) of about 110° C., pH 4.5, no added calcium.

Dry Mill Ethanol Production

The invention provides methods for Dry Mill Ethanol Production using enzymes of the invention, e.g., amylase SEQ ID NO:437, or another enzyme of the invention.

In evaluating enzymes of the invention for use in Dry Mill Ethanol Production, particularly, liquefaction of dry mill corn flour, a bench scale reactor was used with corn flour sourced from commercial dry mill. TERMAMYL™ SC (Novozymes A/S, Denmark) amylase was used as a competitive benchmark. Test found optimum conditions to be 85° C., pH 5.7. Five independent variables were studied: temperature (in a range of between 80° C. to 100° C.), enzyme dose of between 0.2 to 1.0 g/kg starch, pH 4.4 to 6.0, calcium in a range between 0 ppm to 200 ppm, and a recycled backset between about 0% to 40%.

At 95° C. amylase SEQ ID NO:437 reduces viscosity of dry mill corn flour more rapidly than TERMAMYL™ SC (Novozymes A/S, Denmark) amylase at its optimum conditions, including at 85° C. The rate of viscosity reduction by amylase SEQ ID NO:437 was influenced most by enzyme dose and temperature. The optimal range was found to be in the range of 0.4 to 0.6 g/kg starch, with an optimum temperature at 95° C. The amylase SEQ ID NO:437 was effective at a lower pH and a higher temperature than TERMAMYL™ SC (Novozymes A/S, Denmark) amylase at a pH in the range between pH 4.4 and pH 5.6. Calcium addition had a minimal effect on rate of viscosity reduction at 95° C. The amylase SEQ ID NO:437 was effective in the presence of a 30% recycled backset (e.g., thin stillage, spent wash=recycling byproducts back into liquefaction). FIG. 29 shows data summarizing these findings comparing amylase SEQ ID NO:437 with TERMAMYL™ SC (Novozymes A/S, Denmark) amylase in dry mill ethanol processing.

In alternative aspects, use of amylase SEQ ID NO:437 in dry mill ethanol processes can provide operational advantages, for example: rapid reduction in viscosity of slurried corn flour, making an increase in dissolved solids and throughput possible without additional capital investment; superior thermal stability to best competitor, which eliminates split dosing (amylase SEQ ID NO:437 is a thermostable enzyme and eliminates the need to dose before jet cooking and after), lower viscosities are obtained at higher process temperatures, and provides improved microbial control in slurry tank (process is run at higher temperature, so unwanted microbes are killed); lower liquefaction pH, which eliminates need for pH adjustment, decreases scale formation (calcium oxalate precipitate forms on hardware, etc.; if liquefaction done at low pH, there is a higher potential for scale formation) and reduces byproduct formation.

In summary, amylase SEQ ID NO:437 is a thermostable enzyme that can meet key industry needs, for example, under certain conditions, rapidly reduces viscosity of high dry solids corn flour slurry, can be thermostable (optimum temperature 95° C.), can be calcium independent, can be active under low pH optimum, and can tolerate up to 30% recycled backset. In one aspect, the recommended dose is in the range of between about 0.4 to 0.6 kg/MT starch.

Example 2

Thermostable Amylases Active at Alkaline pH

The following example describes an exemplary method for determining if a polypeptide is within the scope of the invention, e.g., is a thermostable amylase.

The initial focus of this example was the evaluation of an existing panel of amylases in an commercial automatic dish wash (ADW) formulation. This effort identified two candidates: one with activity at high pH (SEQ ID NO.:115) and another with stability in the ADW formulation (SEQ ID NO.: 207). Studies also included the identification of high pH amylases. This effort afforded the discovery of hundreds of clones having the ability to degrade starch. DNA sequence and bioinformatics analyses classified many of these genes as previously unidentified amylases. The remaining open reading frames were neopullulanases, amylopullulanases and amylomaltases. Extensive biochemical and applications studies showed that 3 candidates: clone B, SEQ ID NO.:147 and SEQ ID NO.:139) have high specific activity at pH10, but unfortunately lack stability in the ADW formulation. In summary, a panel of novel amylases each having desirable phenotypes for the ADW application has been identified.

Biochemical Studies

Biochemical analysis of the amylase genomic clones showed that many of them hydrolyzed starch at pH 10 and 50° C. To produce sufficient quantities of enzyme for further biochemical and applications testing, the amylase open reading frames of the 40 most active genomic clones were subcloned into expression vectors. This effort included making 2 constructs for those clones containing a putative signal sequence and establishing the growth and induction conditions for each subclone (plus and minus the amylase signal peptide).

Soluble, active protein was successfully purified to homogeneity from 34 subclones and specific activity (units/mg, where 1 unit=µmol reducing sugars/min) was measured at pH 8 and pH 10 (40° C. and 50° C.) using 2% starch in buffer. The amylase from *Bacillus licheniformis* (SEQ ID NO.:113) was chosen as the benchmark for these studies. Specific activity was determined by removing samples at various time points during a 30 minute reaction and analyzing for reducing sugars. The initial rate was determined by fitting the progress curves to a linear equation. A comparison of the top candidates is shown in Table 2.

A study to determine the dependence of hydrolysis rate on pH showed that only clone B is an "alkaline amylase" with a pH optimum of approximately 8; all others had pH optima of 7 or less. Nevertheless, it is clear that the panel of hits included several lead amylases with appreciable activity at pH 10 and 50° C.

TABLE 2

Specific activities (U/mg pure enzyme) of amylases

| Enzyme | Specific activity pH 8, 40° C. | Specific activity pH 10, 50° C. |
|---|---|---|
| Clone B | 682 | 20 |
| SEQ ID NO.: 139 | 430 | 33 |
| SEQ ID NO.: 127 | 250 | 47 |
| SEQ ID NO.: 137 | 230 | 3 |

TABLE 2-continued

Specific activities (U/mg pure enzyme) of amylases

| Enzyme | Specific activity pH 8, 40° C. | Specific activity pH 10, 50° C. |
|---|---|---|
| SEQ ID NO.: 113 (*B. licheniformis*) | 228 | 27 |
| SEQ ID NO.: 205 | 163 | 4 |
| Remainder | <40 | |

Stability

Figure 13:
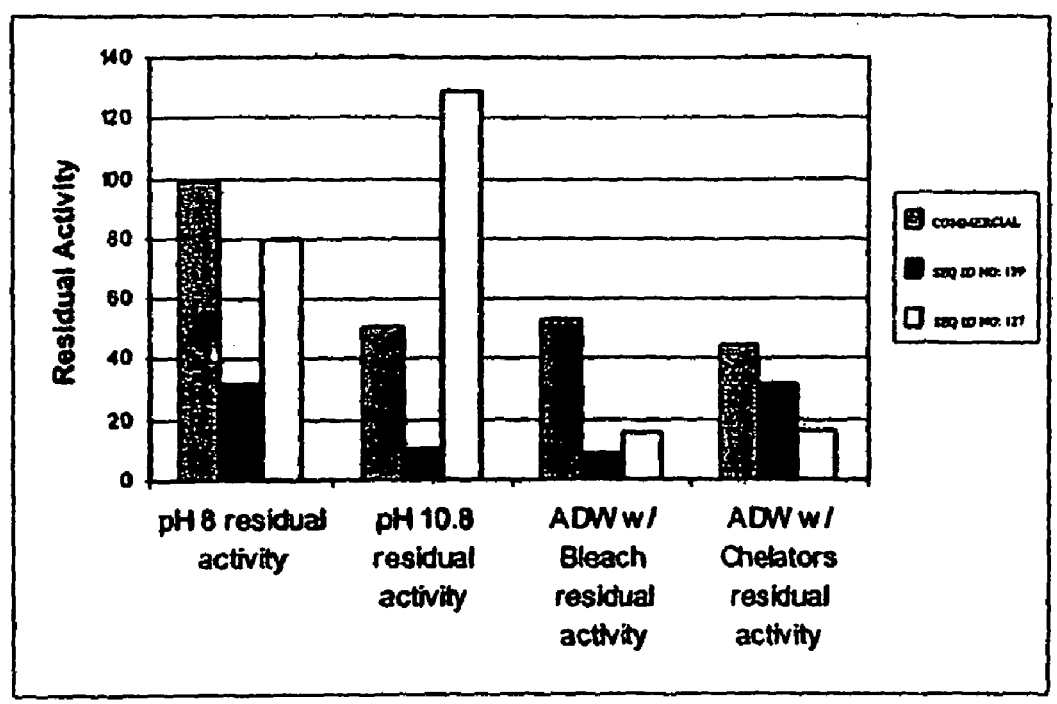
FIG. 13 shows the stability of exemplary amylases vs. a commercial enzyme, as discussed in Example 2.
Figure 15:
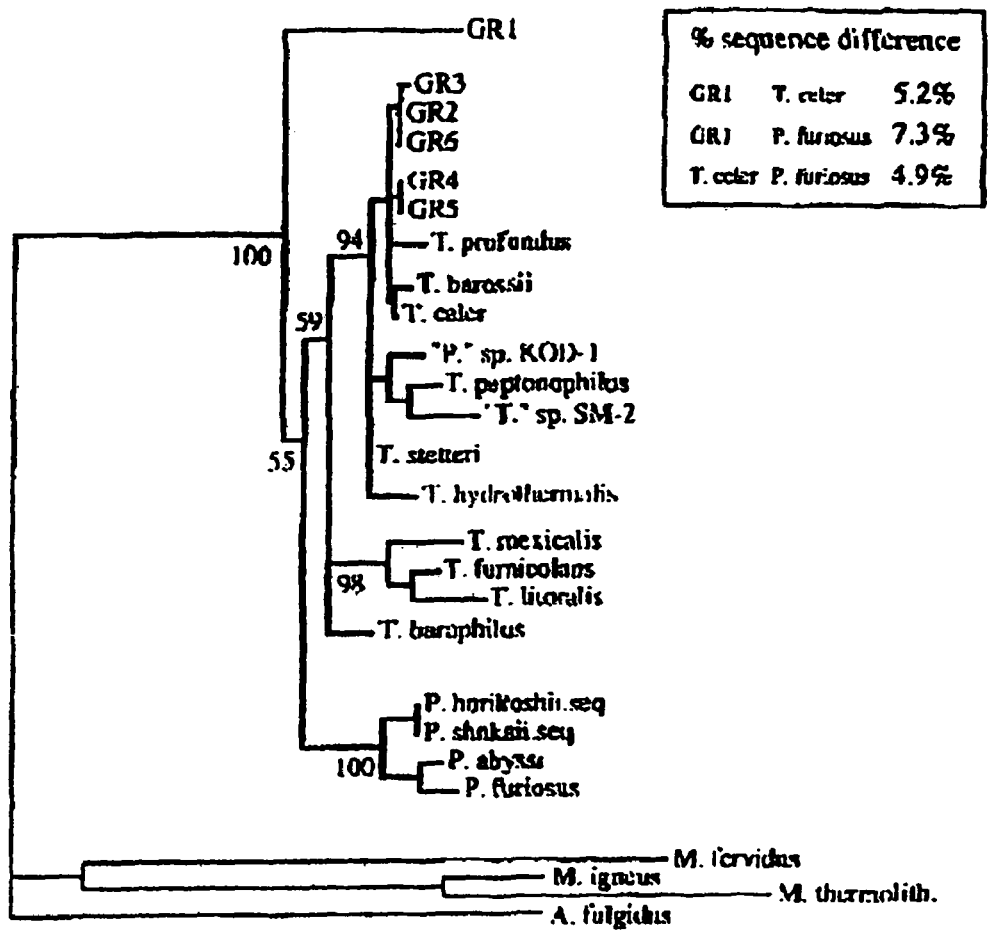
FIG. 15 is a neighbor-joining tree for *Thermococcales*.

Stability in the presence of the ADW formulation was measured for each of the 3 top candidates identified via biochemical analysis. The benchmark for these studies was a commercial enzyme in the formulation matrix. FIG. 13 illustrates the residual activity (measured at pH 8 and 50° C.) after a 30 minute incubation at 50° C. in the presence of various components of the ADW formulation; pH 8, pH 10.8, ADW solution (with bleach) and ADW solution (without bleach). The measured activity after the incubation is expressed as a percentage of the original activity. The data show that clone B was very sensitive to high temperature, whereas the other amylases were less affected. When the enzymes were incubated at high pH and temperature, the commercial enzyme SEQ ID NO.: 139 became less stable; however, SEQ ID NO.: 127 retained full activity. The apparently anomalous behavior of SEQ ID NO.: 127 after pH 10 incubation vs pH 8 was observed in repeated trials.

When amylase activity on dye-labeled starch is measured in the ADW matrix at 50° C., the commercial amylase exhibits roughly 5% of its activity at pH 8. In the same assay, clone B, SEQ ID NO.: 139 and SEQ ID NO.: 127 exhibit <2% of their original activity measured at pH 8.

Wash Tests

Figure 6:
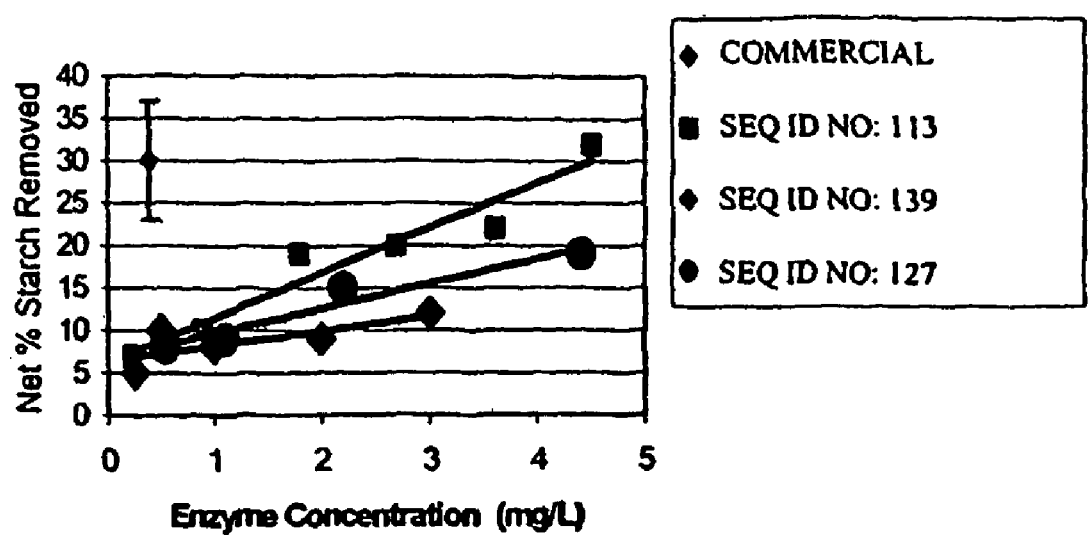
FIG. 6 is a graph showing the net percent starch removed versus enzyme concentration in ADW wash test with bleach and chelators.

Wash tests using starch coated slides were carried out to gauge the performance of each of the purified enzymes as compared to the commercial amylase. The spaghetti starch coated slides were prepared according to protocol. Two pre-weighed starch coated slides were placed back to back in a 50 mL conical tube and 25 mL of ADW solution, ± enzyme were added per tube. The tubes were incubated for 20 minutes at 50° C. with gentle rotation on a vertical carousel. Following the incubation period, the slides were immediately rinsed in water and oven dried overnight. All trials were run in duplicate and the commercial enzyme was run as a positive control. The results (FIG. 6) of these experiments are expressed as net % starch removed, e.g. % of starch removed in ADW with enzyme, minus the % of starch removed in ADW alone.

Example 3

Gene Optimization

The following example describes an exemplary method for determining if a polypeptide is within the scope of the invention, e.g., assessing enzyme performance in the presence of ADW performance.

The properties of enzymes may be improved by various evolution strategies, including GeneSiteSaturationMutagenesis (GSSM™) and GeneReassembly™. (Diversa Corporation, San Diego, Calif.). Such techniques will be applied to the amylase nucleic acids of the invention in order to generate pools of variants that can be screened for improved performance. In one aspect, parental molecules for evolution include any nucleic acid of the invention, e.g., are one or all of the following: SEQ ID NO.: 113, SEQ ID NO.: 139, SEQ ID NO.:115 and SEQ ID NO.: 127 (a truncated form of SEQ ID NO.: 127).

Figure 7:
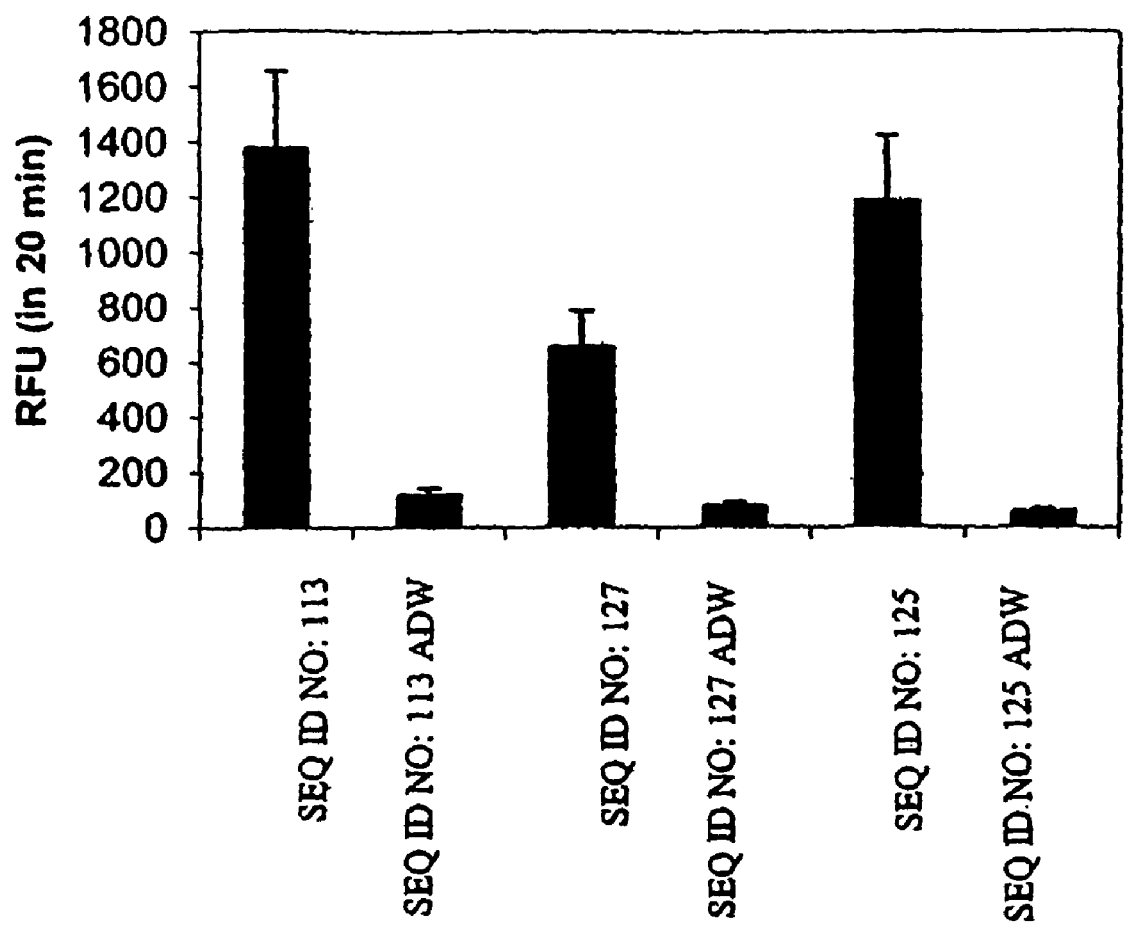
FIG. 7 is a graph showing the activity of parental amylases at pH 8, 40° C. in ADW formulation at 55° C.

A high throughput screen has been developed to assess enzyme performance in the presence of ADW performance. Development of a HTS is of paramount importance in any evolution program The HTS is automated and has showed consistent results for the parental amylases (FIG. 7). Parental amylases have measurable activity in the ADW formulation, however highly reduced relative to pH 8 activity.

Example 4

Characterization of α-Amylases Having Activity at Alkaline pH

The following example describes an exemplary method for determining if a polypeptide is within the scope of the invention, for example, has alpha-amylase activity at alkaline pH.

Amylases of the invention having activity at alkaline pH were characterized further. Kinetics on 2% starch at pH 8 and 10 (40° C. and 50° C.) have been performed.

TABLE 4

| Clones, specific activities | pH 8, 40° C. | pH 10, 50° C. |
|---|---|---|
| SEQ ID NO.: 113 (*B. lichenoformis*) | 228 units/mg | 27 units/mg |
| Clone B | 682 units/mg | 31 units/mg |
| SEQ ID NO.: 139 | 430 units/mg | 33 units/mg |
| SEQ ID NO.: 127 | 540 units/mg | 50 units/mg |
| control 0GL5 (*E. coli*) | 1.8 units/mg | 0 units/mg |

1 unit of activity is defined as release of 1 μmol reducing sugars per minute.

Example 5

Amylase Activity Assay: BCA Reducing Ends Assay

The following example describes an exemplary method for determining if a polypeptide is within the scope of the invention, for example, by a BCA reducing ends assay. Amylase activity of clones of interest was determined using the following methodology.

1. Prepare 2 substrate solutions, as follows:
   a) 2% soluble starch (potato) pH 8 solution by dissolving 2 gm potato starch in 100 ml 100 mM sodium phosphate pH 8).
   b) 2% soluble starch (potato) pH 10 solution by dissolving 2 gm potato starch in 100 ml 100 mM sodium carbonate.

Heat both solutions in a boiling water bath, while mixing, for 30-40 minutes until starch dissolves.

2. Prepare Solution A from 64 mg/ml sodium carbonate monohydrate, 24 mg/ml sodium bicarbonate and 1.95 mg/ml BCA (4,4'-dicarboxy-2,2'-biquinoline disodium salt (Sigma Chemical cat #D-8284). Added above to dH2O.

3. Prepare solution B by combining 1.24 mg/ml cupric sulfate pentahydrate and 1.26 mg/ml L-serine. Add mixture to dH2O.

4. Prepare a working reagent of a 1:1 ration of solutions A and B.

5. Prepare a Maltose standard solution of 10 mM Maltose in dH2O, where the 10 mM maltose is combined in 2% soluble starch at desired pH to a final concentration of 0, 100, 200, 300, 400, 600 μM. The standard curve will be generated for each set of time-points. Since the curve is determined by adding 10 ul of the standards to the working reagent it works out to 0, 1, 2, 3, 4, 6 nmole maltose.

6. Aliquot 1 ml of substrate solution into microcentrifuge tubes, equilibrate to desired temperature (5 min) in heat block or heated water bath. Add 50 ul of enzyme solution to the inside of the tube lid.

7. While solution is equilibrating mix 5 ml of both solution A & B. Aliquot 100 ul to 96 well PCR plate. Set plate on ice.

8. After 5 minute temperature equilibration, close lid on tubes, invert and vortex 3 times. Immediately aliquot 10 ul into plate as t=0 (zero time point). Leave enzyme mixture in heat block and aliquot 10 ul at each desired time point (e.g. 0, 5, 10, 15, 20, 30 minutes).

9. Ensure that 12 wells are left empty (only working reagent aliquotted) for the addition of 10 ul of standards, for the standard curve.

10. When all time points are collected and standards are added, cover plate and heated to 80° C. for 35 min. Cool plate on ice for 10 min. Add 100 ul H2O to all wells. Mix and aliquot 100 ul into flat bottomed 96-well plate and read absorbance at 560 nm.

Figure 11:
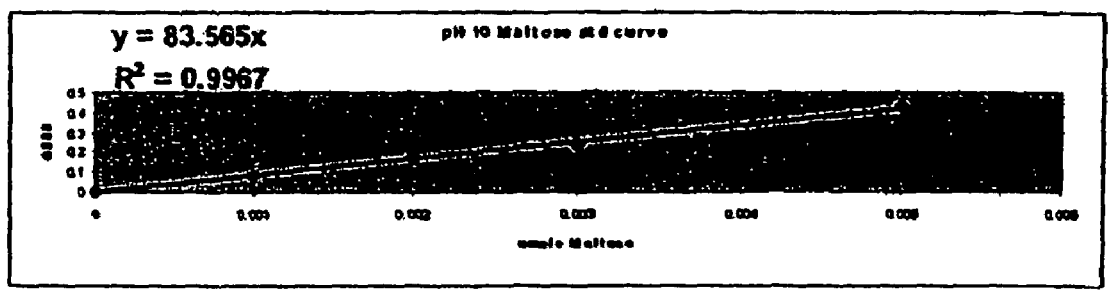
FIG. 11 illustrates a sample Standard Curve of the assay of Example 5.
Figure 12:
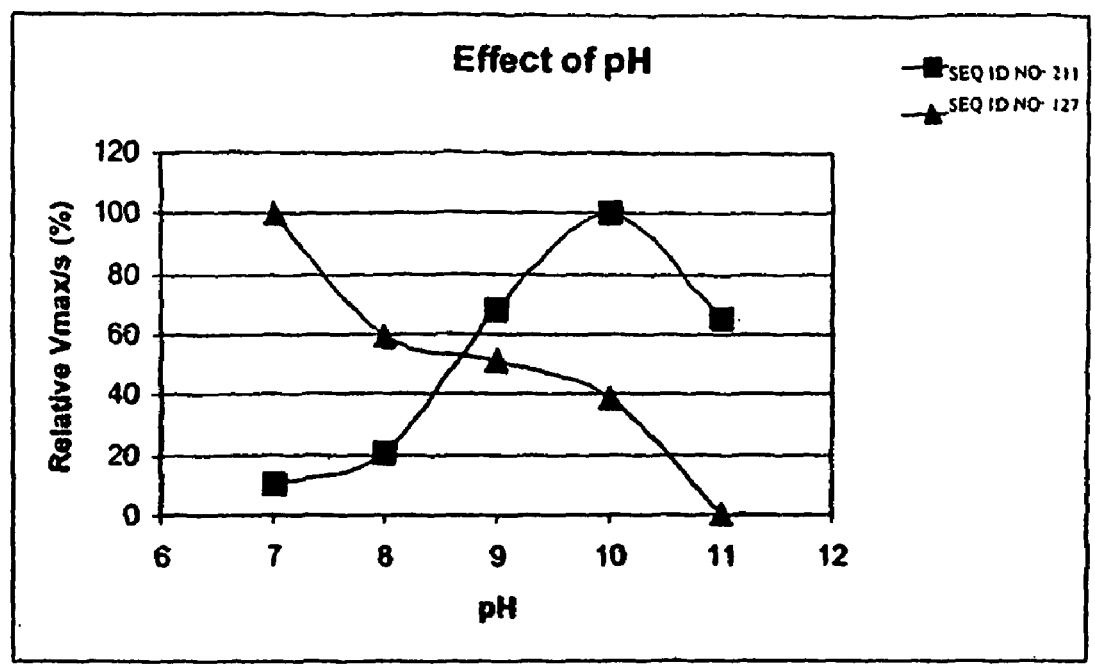
FIG. 12 illustrates the pH rate profiles for SEQ ID NO.: 127, which has a neutral optimum pH and SEQ ID NO.: 211, which has an optimum around pH 10.

11. Zero each sample's time points against its own t=0 (subtract the average t=0 A560 value from other average A560 values). Convert the $A560_{(experimental)}$ to umole (Divide $A560_{(experimental)}$ by the slope of the standard curve (A560/umole). Generate a slope of the time points and the umole (in umole/min), multiply by 100 (as the umole value only accounts for the 10 ul used in the assay, not the amount made in the 1 ml rxn). To get the specific activity divide the slope (in umole/min) by the mg of protein. All points should be done at a minimum in duplicate with three being best. An example standard curve is set forth in FIG. 11.

TABLE 5

| | | | Sample data: | | | | |
|---|---|---|---|---|---|---|---|
| Clone | Dilution | Minutes | A560-1 | A560-2 | Avg A 560 | Zeroed A 560 | (A560exp/std slope) umole |
| ENZ | 50 | 0 | 0.1711 | 0.1736 | 0.17235 | 0 | 0.0000 |
| | | 5 | 0.2104 | 0.2165 | 0.21345 | 0.0411 | 0.0005 |
| | | 10 | 0.2492 | 0.2481 | 0.24865 | 0.0763 | 0.0009 |
| | | 15 | 0.2984 | 0.2882 | 0.2933 | 0.12095 | 0.0014 |
| | | 20 | 0.3355 | 0.3409 | 0.3382 | 0.16585 | 0.0020 |
| | | 30 | 0.3942 | 0.3805 | 0.38735 | 0.215 | 0.0026 |
| | | 40 | 0.4501 | 0.4412 | 0.44565 | 0.2733 | 0.0033 |

Activity=0.008646 umole/min
Divide protein concentration (mg/ml) by any dilution to get mg used in assay.
Divide the above slope by mg used in assay to get specific activity
Specific Activity=24.93 umole/min/mg
See for example, Dominic W. S. Wong, Sarah B. Batt, and George H. Robertson (2000) J. Agric. Food Chem. 48:4540-4543; Jeffrey D. Fox and John F. Robyt, (1991) Anal. Biochem. 195, 93-96.

Example 6

Screening for α-Amylase Activity

The following example describes an exemplary method for determining if a polypeptide is within the scope of the invention. Amylase activity of clones can be assessed by a number of methods known in the art. The following is the general methodology that was used in the present invention. The number of plaques screened, per plate, should be approximately 10,000 pfu's. For each DNA library: at least 50,000 plaques per isolated library and 200,000 plaques per non-isolated library should be screened depending upon the pfu titer for the λ Zap Express amplified lysate.

Titer Determination of Lambda Library
1) μL of Lambda Zap Express amplified library stock added to 600 μL E. coli MRF' cells ($OD_{600}$=1.0). To dilute MRF' stock, 10 mM $MgSO_4$ is used.
2) Incubate at 37° C. for 15 minutes.
3) Transfer suspension to 5-6 mL of NZY top agar at 50° C. and gently mix.
4) Immediately pour agar solution onto large (150 mm) NZY media plate.
5) Allow top agar to solidify completely (approximately 30 minutes), then invert plate.
6) Incubate the plate at 39° C. for 8-12 hours.
7) Number of plaques is approximated. Phage titer determined to give 10,000 pfu/plate. Dilute an aliquot of Library phage with SM buffer if needed.

Substrate Screening
1) Lambda Zap Express (50,000 pfu) from amplified library added to 600 μL of E. coli MRF' cells (OD600=1.0). For non-environment libraries, prepare 4 tubes (50,000 pfu per tube).
2) Incubate at 37° C. for 15 minutes.
3) While phage/cell suspensions are incubating, 1.0 mL of red starch substrate (1.2% w/v) is added to 6.0 mL NZY top agar at 50° C. and mixed thoroughly. Keep solution at 50° C. until needed.
4) Transfer ⅕ (10,000 pfu) of the cell suspension to substrate/top agar solution and gently mixed.
5) Solution is immediately poured onto large (150 mm) NZY media plate.
6) Allow top agar to solidify completely (approximately 30 minutes), then invert plate.
7) Repeat procedures 4-6 4 times for the rest of the cell suspension (⅕ of the suspension each time).
8) Incubate plates at 39° C. for 8-12 hours.
9) Plate observed for clearing zones (halos) around plaques.
10) Plaques with halos are cored out of agar and transferred to a sterile micro tube. A large bore 200 μL pipette tip works well to remove (core) the agar plug containing the desired plaque.
11) Phages are re-suspended in 500 μL SM buffer. 20 μL Chloroform is added to inhibit any further cell growth.
12) Pure phage suspension is incubated at room temperature for 4 hours or overnight before next step.

Isolation of Pure Clones
1) 10 μL of re-suspended phage suspension is added to 500 μL of E. coli MRF' cells (OD600=1.0).
2) Incubate at 37° C. for 15 minutes.
3) While phage/cell suspension is incubating, 1 mL of red starch substrate (1.2% w/v) is added to 6.0 mL NZY top agar at 50° C. and mixed thoroughly. Keep solution at 50° C. until needed.
4) Cell suspension is transferred to substrate/top agar solution and gently mixed.
5) Solution is immediately poured onto large (150 mm) NZY media plate.
6) Allow top agar to solidify completely (approximately 30 minutes), then invert plate.
7) Plate incubated at 39° C. for 8-12 hours.
8) Plate observed for a clearing zone (halo) around a single plaque (pure clone). If a single plaque cannot be isolated, adjust titer and re-plate phage suspension.
9) Single plaque with halo is cored out of agar and transferred to a sterile micro tube. A large bore 200 μL pipette tip works well to remove (core) the agar plug containing the desired plaque. To amplify the titer, core 5 single active plaques into a micro tube.
10) Phages are re-suspended in 500 μL SM buffer. 20 μL Chloroform is added to inhibit any further cell growth.
11) Pure phage suspension is incubated at room temperature for 4 hours or overnight before next step. The pure phage suspension is stored at −80° C. by adding DMSO into the phage suspension (7% v/v).

Excision of Pure Clone
1) 100 μL of pure phage suspension is added to 200 μL E. coli MRF' cells (OD600=1.0). To this, 1.0 μL of EXASSIST helper phage (>1×106 pfu/mL; Stratagene) is added. Use 2059 Falcon tube for excision.
2) Suspension is incubated at 37° C. for 15 minutes.
3) 3.0 mL of 2× YT media is added to cell suspension.
4) Incubate at 30° C. for at least 6 hours or overnight while shaking.
5) Tube transferred to 70° C. for 20 minutes. The phagemid suspension can be stored at 4° C. for 1 to 2 months.
6) 100 μL of phagemid suspension transferred to a micro tube containing 200 μL of E. coli Exp 505 cells (OD600=1.0).
7) Suspension incubated at 37° C. for 15 minutes.
8) 300 μL of SOB is added to the suspension.
9) Suspension is incubated at 37° C. for 30 to 45 minutes.
10) 100 μL of suspension is transferred to a small (90 mm) LB media plate containing Kanamycin (LB media with Kanamycin 50 μg/mL) for Zap Express DNA libraries or Ampicillin (LB media with Kanamycin 100 μg/mL) for Zap II DNA libraries.
11) The rest of suspension is transferred to another small LB media plate.
12) Use sterile glass beads to evenly distribute suspension on the plate.
13) Plates are incubated at 30° C. for 12 to 24 hours.
14) Plate observed for colonies.
15) Inoculate single colony into LB liquid media containing suitable antibiotic and incubate at 30° C. for 12 to 24 hours.
16) Glycerol stock can be prepared by adding 80% glycerol into liquid culture (15% v/v) and stored at −80° C.

Activity Verification
1) 50 μL of liquid culture is transferred to a micro tube. Add 500 μL of 8% pH7 Amylopectin Azure into the same tube. Prepare 2 tubes for each clone.

2) Activity is tested at 50° C. for 3 hours and overnight. Use pH 7 buffer as control.
3) Cool the test specimen at ice-water bath for 5 minutes.
4) Add 750 μL of Ethaqnol and mixed thoroughly.
5) Centrifuge at 13000 rpm (16000 g's) for 5 minutes.
6) Measure OD of the supernatant at 595 nm.

RFLP Analysis
1) 1.0 mL of liquid culture is transferred to a sterile micro tube.
2) Centrifuge at 13200 rpm (16000 g's) for 1 minute.
3) Discard the supernatant. Add another 1.0 mL of liquid culture into the same sterile micro tube.
4) Centrifuge at 13200 rpm (16000 g's) for 1 minute.
5) Discard the supernatant.
6) Follow QIAprep spin mini kit protocol for plasmid isolation.
7) Check DNA concentration using BioPhotometer.
8) Use Sac I and Kpn I for first double digestion. Incubate at 37° C. for 1 hour.
9) Use Pst I and Xho I for second double digestion. Incubate at 37° C. for 1 hour.
10) Add Loading dye into the digested sample.
11) Run the digested sample on a 1.0% agarose gel for 1-1.5 hours at 120 volts.
12) View gel with gel imager. All clones with a different digest pattern will be sent for sequence analysis.

Example 7

Assay for Amylases

The following example describes an exemplary method for determining if a polypeptide is within the scope of the invention.

Preparation of Host Cultures
1. Start an overnight culture of XL1-Blue MRF' host cells. Use a single colony from a streak plate to inoculate 10 mL LB supplemented with 20 ug/mL tetracycline. Grow overnight culture shaking at 37° C. for at least 16 hours.
2. Using aseptic technique, inoculate a fresh 100 mL of $LB_{Tet}$ day culture with XL1-Blue MRF' host from the overnight $LB_{Tet}$ culture.
3. Grow in a 37° C. shaker until the OD reaches 0.75-1.0.
4. Pellet host cells at 1000×g for 10 minutes and gently resuspend in 10 mM $MgSO_4$ at OD5.
5. Dilute a small amount of host cells to OD1 for use in titering and pintooling.
6. Host preparations can be used for up to 1 week when stored on ice or at 4° C.
   To shorten growth time for the day culture, use ½× the usual Tet concentration in LB (½×=10 ug/mL), or omit the antibiotic altogether.
   Do not use NZY when selecting with Tetracycline. The high $Mg^{++}$ concentration in NZY medium renders Tet inactive.

Titering Lambda Libraries
7. Place three sterile microfuge tubes in a rack.
8. Aliquot 995 uL prepared host cells in one tube and 45 uL prepared OD1 host cells into each of the two remaining tubes.
9. Add 5 uL of lambda library to the tube containing 995 uL host cells and mix by vortexing. This results in a dilution factor of 200.
10. Prepare 1/2,000 and 1/20,000 dilutions by consecutively adding 5 uL of previous dilution to the remaining two tubes containing 45 uL prepared host cells. Mix by vortexing after each dilution was made.
11. Allow phage to adsorb to host by incubating at 37° C. for 15 minutes.
12. Meanwhile, pipet 100 uL of prepared OD1 host cells to each of three Falcon 2059 tubes.
13. Add 5 uL of each dilution to a separate 2059 tube containing host cells.
14. Plate each by adding 3 mL top agar to each tube and quickly pour over 90 mm NZY plates. Ensure a smooth, even distribution before the top agar hardens.
15. Invert plates and incubate at 37° C. overnight.
16. Count plaques and calculate titer of the library stock (in plaque forming units (pfu) per uL).

Lambda Microtiter Screening For Amylases
Preparation
1. Prepare a sufficient amount of XL1-Blue MRF' host culture, as described above, for the amount of screening planned. A culture of 100 mL is usually sufficient for screening 2-3 libraries.
2. Autoclave several bottles compatible with the QFill2 dispenser. These are the wide-mouth Corning bottles, 250 mL containing a sealing ring around the lip.
3. Make sure there are sufficient amounts of plates, top agar, BODIPY starch, red starch solution, etc. available for the screen.
4. Schedule the Day 2 robot run with a representative from Automation.

Day 1
1. Label the 1536-well plates (black) with library screen and plate number. Tough-Tags™ tube stickers, cut in half width-wise, are ideal for labeling 1536 well plates.
2. Calculate volumes of library, host cells and NZY medium necessary for the screen. This is easily done with an Excel spreadsheet.
3. Combine the calculated volumes of lambda library and OD5 host cells in a sterile 250 mL wide-mouth Corning bottle (containing a sealing ring).
4. Allow adsorption to occur at 37° C. for 15 minutes.
5. Add the calculated volume of NZY medium and mix well. This is referred to as the cell-phage-medium suspension.
6. Perform a concomitant titer by combining 50 uL of the cell-phage-medium suspension with 250 uL of OD1 host cells in a Falcon 2059 tube, then plating with 9 mL of top agar onto a 150 mm NZY plate. Incubate concomitant titer plate at 37° C. overnight.
7. Load the dispenser with the remainder of the suspension and array each labeled 1536-well plate at 4 uL per well. If the dispenser leaves air bubbles in some wells, they can be removed by centrifuging the plates at 200×g for 1 minute.
8. Add 0.5 uL of positive control phage to well position AD46 of at least two of the assay plates. Use a strong amylase-positive lambda clone for this purpose. The lambda versions of SEQ ID NO.: 113 or SEQ ID NO.: 199 are good choices for positive controls.
9. Incubate assay plates at 37° C. overnight in a humidified (≧95%) incubator.

Day 2
1. Count the pfu on the concomitant titer plate and determine the average seed density per well (in pfu per well).
2. Pintool at least 2 plates of each library screen (preferably the 2 containing positive controls) as follows:
   a) Prepare 2 host lawn plates to act as a surface on which to pintool: combine 250 uL of OD1 host cells with 2 mL 2% red starch and plate with 9 mL top agar onto 150 mm NZY plates. Hold each plate as level as possible as the top agar solidifies in order to produce an even hue of red across the plate.
  b) Using a twice flame-sterilized 1536 position pintool, replicate at least 2 of the screening plates onto the host lawn plates.
  c) Place the pintooled recipient plates in a laminar flow hood with the lids off for about 15-30 minutes (to vent off excess moisture).
  d) Replace the lids and incubate inverted at 37° C. overnight.
3. Prepare the 2× BODIPY starch substrate buffer as follows:
  a) Calculate the total volume of 2× substrate buffer solution needed for all screening plates at 4 uL per well (including any extra deadspace volume required by the dispenser) and measure this amount of 100 mM CAPS pH 10.4 into a vessel appropriate for the dispenser used.
  b) Retrieve enough 0.5 mg tubes of BODIPY starch to produce the required volume of 2× substrate buffer [calculated in step a) above] at a final concentration of 20-30 ug/mL.
  c) Dissolve each 0.5 mg tube in 50 uL DMSO at room temperature, protected from light, with frequent vortexing. This takes more than 15 minutes; some production lots of BODIPY starch dissolve better than others.
  d) Add 50 uL 100 mM CAPS buffer pH 10.4 to each tube and mix by vortexing.
  e) Pool the contents of all tubes and remove any undissolved aggregates by centrifuging for 1 minute at maximum speed in a microfuge.
  f) Add the supernatant to the rest of the 100 mM CAPS buffer measured in step a) above.
  g) Protect the 2× substrate buffer from light by wrapping in foil.
4. Take plates and substrate buffer to the automation room and program the robot with the following parameters:
  a) dispense 4 uL substrate buffer per well
  b) $1^{st}$ read at 1 hour post-substrate, $2^{nd}$ read at 9 hours, and third read at 17 hours; with 37° C. incubation between reads
  c) excitation filter: 485 nm; emission filter: 535 nm
  d) set the Spectrafluor gain at 70, or the optimal gain for the batch of 2× substrate buffer prepared.
  e) ensure that the incubator used will protect assay plates from light.

Day 3
1. Check pintooled plates for clearings in the bacterial lawn at all positions corresponding to wells on the associated assay plate. Also check for clearings in the red starch in any of the pin positions. If plates containing positive controls were used for pintooling, you should be able to see a large clearing zone in the red background. Be wary of contaminants that also form clearing zones in red starch (see comment "Contaminants That Form Clearing Zones in Red Starch" at end of Example 7).
2. Identify putative hits from the data file produced by the robot computer. The KANAL program produced by Engineering simplifies data analysis. As a rule of thumb, a putative hit is characterized as a well having signal intensity rising at least 1.5 fold over background.
3. For each putative, remove 2 uL from the well and add to a tube containing 500 uL SM buffer and 50 uL CHCl3. Vortex to mix and store at 4° C. This solution will be referred to hereafter as the 4e-3 stock. The original screening plates should be stored at 4° C., protected from light, at least until breakouts are complete.

This is the recommended method of breaking out putative hits. It is a liquid phase assay that relies on confirmation of activity on BODIPY starch. Alternatively, putative hits can be plated directly onto solid phase plates containing red starch such that 2,000-3,000 pfu per hit are examined for clearing zones. However, inability to observe clearing zones on red starch is not necessarily an indication that a putative hit was a false positive. It would then need to be assayed using the format in which it was originally identified (i.e., liquid phase using BODIPY starch as substrate). In addition, very weak positives are more easily identified using the method detailed below.

Day 1
1. In a sterile 50 mL conical tube, combine 0.5 mL OD5 host cells with 45.5 mL NZY. This will be referred to as the host-medium suspension.
2. For each putative hit to be analyzed, aliquot 1 mL of host-medium suspension into each of 3 three sterile microfuge tubes.
3. Set the 12-channel pipetman in multidispense mode with an aliquot size of 20 uL and an aliquot number of 2×. Mount the pipetman with a clean set of sterile tips.
4. Pour about 1 mL of host-medium suspension into a new sterile solution basin and load the multichannel pipetman.
5. Dispense 20 uL per well into the last row (row P) of a black 384-well plate (12 channels×2=24 wells). This row will be used later for the controls.
6. Expel the remaining liquid in the tips by touching the tips against the surface of the basin and pressing the RESET button on the pipetman. Lay the pipetman down in a way to prevent contamination of the tips. There is no need to change the tips at this point.
7. Pour the remainder of the fluid in the basin into a waste container (like a beaker) taking care to avoid splash-back contamination.
8. For the first putative to be analyzed, take 111 uL of the 4e-3 stock (see Day 2 in *Lambda Microtiter Screening for Amylases*) and add it to the first in a set of three tubes containing 1 mL host-medium suspension (step 2). Vortex to mix. This is Dilution A.
9. Take 111 uL of Dilution A and add to the next tube in the set. Vortex to mix. This is Dilution B.
10. Take 111 uL of Dilution B and add to the last tube in the set. Vortex to mix. This is Dilution C. You should now have three dilutions of phage, where concentrations of each differ by a factor of 10.
11. Pour the contents of Dilution C (the most dilute of the 3 samples) into the solution basin and load the multichannel pipetman.
12. Dispense 20 uL per well into the first row of the 384-well plate (12 channels×2=24 wells).
13. Expel the remaining liquid in the tips by touching the tips against the surface of the basin and pressing the RESET button on the pipetman. Lay the pipetman down in a way to prevent contamination of the tips. There is no need to change the tips at this point.
14. Empty the basin as described above.
15. Pour the contents of Dilution B into the same basin and load the multichannel pipetman.
16. Dispense 20 uL per well into the second row of the 384-well plate.
17. Perform steps 13-16 similarly to dispense Dilution A into the third row of the plate.

18. After all three dilutions have been arrayed into the first 3 rows of the plate, discard all tips and the solution basin into the biohazardous waste container.
19. Mount the pipetman with a clean set of sterile tips and open a new sterile solution basin.
20. Repeat steps 8-19 for each remaining putative hit, using remaining rows on the plate up to row O. Five putative hits can be analyzed on one 384-well plate, with the last row (row P) saved for the controls.
21. Add 0.5 uL of each control to a separate well. Use at least 2-3 separate controls, preferably covering a range of activity.
22. Incubate assay plates at 37° C. overnight in a humidified (≧95%) incubator.

Day 2
1. Pintool all breakout plates onto a host lawn with red starch using the same method described for Day 2 in Lambda Microtiter Screening for Amylases, except that a 384 position pintool is used.
2. Prepare the 2× BODIPY starch substrate buffer as follows:
    a) Calculate the total volume of 2× substrate buffer solution needed for all breakout plates at 20 uL per well (including any extra deadspace volume required by the dispenser) and measure this amount of 100 mM CAPS pH 10.4 into a vessel appropriate for the dispenser used.
    b) Retrieve enough 0.5 mg tubes of BODIPY starch to produce the required volume of 2× substrate buffer [calculated in step a) above] at a final concentration of 20-30 ug/mL.
    c) Dissolve each 0.5 mg tube in 50 uL DMSO at room temperature, protected from light, with frequent vortexing. This takes more than 15 minutes; some production lots of BODIPY starch dissolve better than others.
    d) Add 50 uL 100 mM CAPS buffer pH 10.4 to each tube and mix by vortexing.
    e) Pool the contents of all tubes and remove any undissolved aggregates by centrifuging for 1 minute at maximum speed in a microfuge.
    f) Add the supernatant to the rest of the 100 mM CAPS buffer measured in step a) above.
    g) Protect the 2× substrate buffer from light by wrapping in foil.
3. Dispense 20 uL per well into all breakout plates.
4. Wrap all plates in aluminum foil and incubate at room temperature for 2-6 hours.
5. Read each plate in the Spectrafluor with the following settings:
    a) fluorescence read (excitation filter: 485 nm; emission filter: 535 nm)
    b) plate definition: 384 well black
    c) read from the top
    d) optimal gain
    e) number of flashes: 3
6. On the resulting Excel spreadsheet, chart each putative's 3 rows in a separate graph and check for activity. Ensure that the positives controls produced signals over background.
7. For each putative that appears to have a real signal among the wells, harvest a sample from a positive well as follows:
    a) Select a positive well from a row representing the highest initial dilution.
    b) Transfer 2 uL from that well into a tube containing 500 uL SM and 50 uL CHCl$_3$. This is referred to as the breakout stock.
    c) Store at 4° C.
8. Using methods previously described, plate about 10 uL of each breakout stock onto 150 mm NZY plates using red starch. The objective is to obtain several (at least 20) well-separated plaques from which to core isolates.

Day 3
1. Check pintooled plates for an acceptable incidence of clearings in the bacterial lawn corresponding to wells on the associated assay plate. Also check for clearings in the red starch in the positive controls and in any tested putatives. Be wary of contaminants that also form clearing zones in red starch (see below).
2. From the solid phase plates containing dilutions of breakout stocks, core several isolated plaques, each into 500 uL SM with 50 uL CHCl$_3$. This is referred to as the isolate stock.
3. The isolate stocks can then be individually tested on BODIPY starch using methods described above. This step can be skipped if the plaque that was cored in step 2 produced a clearing zone in the red starch background. The isolate stocks were then be individually tested on BODIPY starch using methods described above. However, this step may be skipped if the plaque that was cored in step 2 produced a clearing zone in the red starch background.

Excisions
Day 1
1. In a Falcon 2059 tube, mix 200 uL OD1 XL1-Blue MRF' host, 100 uL lambda isolate stock and 1 uL ExAssist phage stock.
2. Incubate in 37° C. shaker for 15 minutes.
3. Add 3 mL NZY medium.
4. Incubate in 30° C. shaker overnight.

Day 2
1. Heat to excision tube to 70° C. for 20 minutes.
2. Centrifuge 1000×g for 10 minutes.
3. In a Falcon 2059 tube, combine 50 uL supernatant with 200 uL EXP505 OD1 host.
4. Incubate in 37° C. shaker for 15 minutes.
5. Add 300 uL SOB medium.
6. Incubate in 37° C. shaker for 30-45 minutes.
7. Plate 50 uL on large LB$_{Kan50}$ plate using sterile glass beads. If the plates are "dry", extra SOB medium can be added to help disburse the cells.
8. Incubate plate at 30° C. for at least 24 hours.
9. Culture an isolate for sequencing and/or RFLP.

Growth at 30° C. reduces plasmid copy number and is used to mitigate the apparent toxicity of some amylase clones.

Contaminants That Form Clearing Zones in Red Starch

When using red starch on solid medium to assay phage for amylase activity, it is common to see contaminating colony forming units (cfu) that form clearing zones in the red starch. For pintooled plates, it is important to distinguish amylase-positive phage clones from these contaminants whenever they align with a particular well position. The source of the contaminating microbes is presumably the 2% red starch stock solution, which cannot be sterilized by autoclaving or by filtering after preparation. It is thought that they are opportunistic organisms that survive by metabolizing the red starch.

In order to reduce these contaminants, use sterile technique when making 2% red starch solutions and store the stocks either at 4° C. or on ice.

Example 8

Bioinformatic Analysis

The following example describes an exemplary method for determining if a polypeptide is within the scope of the invention, e.g., by Bioinformatic Analysis.

An initial bioinformatic analysis was made with the known hyper-thermophilic α-amylase sequences. FIG. 14a shows an alignment of the sequences some of which have been deposited at the NCBI database. This analysis revealed the potential for designing degenerate primers to PCR the entire gene minus its signal sequence (see FIG. 14a), yielding potentially novel full-length alpha amylases from a library.

The following libraries were screened by PCR from genomic DNA:

TABLE 6

| Library # | Name | PCR positive | Subcloned |
|---|---|---|---|
| 5 | A. lithotropicus | No | |
| 13 | Pyrodictium occultum | No | |
| 17 | Pyrodictium TAG11 | No | Yes |
| 113 | Deep sea enrichment | Yes | Yes |
| 170 | Deep sea enrichment | Yes | Yes |
| 198 | Archaeglobus | No | |
| 206 | Acidianus sp | No | |
| 453 | Mixed iceland enrich | No | |
| 455 | Mixed iceland enrich | Yes | Yes |

FIG. 14b shows an alignment of the identified sequences and Table 7, illustrated in FIG. 18, lists their relative percent identities.

The amino acid identity ranges from about 85-98% identity. Accordingly, these sequences are useful in shuffling of genes as described herein.

FIG. 14c shows the nucleic acid alignment of the corresponding polypeptide sequences above. Expression of these amylases in the expression vector pSE420 and the host cell line XL1-Blue showed 1703 and 1706 to have amylase activity.

Example 9

Characterization of Library 63 GP-1 Alpha Amylase pH Optimum and Specific Activity Determination The following example describes an exemplary method for determining if a polypeptide is within the scope of the invention, e.g., by alpha amylase activity pH optimum and specific activity determination.

In initial experiments, the SEQ ID NO: 81 from *Thermococcus* showed that it was effective in both starch liquefaction for corn wet milling and desizing for textiles. This enzyme has a pH optimum of 4.5 to 5.0. At this lower pH, it is possible to use little or no calcium which lowers overall operating costs and less byproduct formation. In addition, at this low pH, there is decreased chemical usage and ion exchange load. The industry standard *B. licheniformis* amylase is suboptimal in both thermostability and pH optimum. The 63GP-1 amylase has a higher application specific activity compared to B. licheniformis amylase and therefore much less enzyme is required to hydrolyze a ton of starch (as much as 20-fold less enzyme can be used).

The pH optimum for the hydrolysis of starch was determined by reacting 50 uL of the GP-1, 0.35 U/ml, with a 100 ml of 1% soluble starch solution (0.0175 U/g of starch) for 30 minutes at 95 degrees C. The reducing ends generated in the liquefied starch solution were measured by the neocupronine assay, described herein. The percent hydrolysis of cornstarch was determined by measuring the number of sugar reducing ends produced with the neocupronine assay. Seventy grams of buffer solution (pH4-7) was weighed and 100 ppm of calcium was added. Thirty grams of cornstarch was mixed into the buffer solution to form a starch slurry. The enzyme was added and the vessels sealed and incubated at 95 degrees C. for 30 minutes with an initial heating rate of six degrees C. per minute. A 1 ml sample was extracted from the reaction beakers and analyzed by the neocupronine assay. The optimum for GP-1 was between pH 4.5 and 5, while the commercial *B. licheniformis* amylase performed optimally at about pH 6.0.

Example 10

Amylase Ligation Reassembly

The following example describes, inter alia, exemplary methods for determining if a polypeptide is within the scope of the invention, e.g., by the assays described below.

Assay Using RBB-starch

75 µL of RBB-starch substrate (1% RBB-insoluble corn starch in 50 mM NaAc buffer, pH=4.5) was added into each well of a new 96-well plate (V-bottom). Five micro-liters of enzyme lysate was transferred into each well with substrate using Biomek or Zymark. The plates were sealed with aluminum sealing tape and shaken briefly on the shaker. The plates were incubated at 90° C. for 30 minutes, followed by cooling at room temperature for about 5 to 10 minutes. One hundred micro-liters of 100% ethanol was added to each well, the plates sealed and shaken briefly on the shaker. The plates were then centrifuged 4000 rpm for 20 minutes using benchtop centrifuge. 100 µl of the supernatant was transferred into a new 96-well plate (flat bottom) by Biomek and read $OD_{595}$. Controls: SEQ ID NO:81, SEQ ID NO:77, SEQ ID NO:79.

Assay Using FITC-Starch

Added 50 µl of substrate (0.01% FITC-starch in 100 mM NaAc buffer, pH=4.5) into each well of a new 384-well plate. Transferred 5 µl of enzyme lysate into each well with substrate and incubated the plate at room temperature overnight. The polarization change of the substrate, excitation 485 nm, emission 535 nm, was read for each well. Controls: SEQ ID NO.: 81, SEQ ID NO.: 77, SEQ ID NO.: 79. Preferably 96 well plates are used for all assays.

Confirmation of New Active Clones

Each positive clone from screening was grown and induced using a standard protocol. Each clone was examined for growth (i.e., cell density over time), activity at per cell level (RBB-starch assay and liquefaction assay), expression (protein gel) and solubility of protein (by microscope analysis). The confirmed new elevated clones were transferred for fermentation.

Example 11

Exemplary Protocol for Liquefying Starch and Measuring Results

The following example described and exemplary protocol for liquefying starch using selected amylases of the invention.

Amylases having a sequence as set forth in SEQ ID NO:10 and SEQ ID NO:4 demonstrated activity on liquefied starch at pH 4.5 or 6.5 using the reaction conditions show below.

Reaction Conditions: 100 mM $PO_4$ pH 6.5, 1% (w/w) liquefied starch DE 12 at 55° C. Both TLC and HPLC assays were done to verify activity. The data from both assays showed that the clones were active.

pH profiles for the amylases having a sequence as set forth in SEQ ID NO:4 and SEQ ID NO:10 were run using phosphate buffer pHed from 3.0-6.5, at 55° C. From the amount of observable hydrolysis, it could be visually said that the clones were more active at certain pH values than at other values at the above indicated reaction conditions:

SEQ ID NO:4—active from pH 5.0-6.5
SEQ ID NO:10—active from pH 4.5-6.5

An exemplary protocol for the saccharification of liquefied starch at pH 6.5:

Adjust the pH of the liquefied starch to the pH at which the saccharification(s) will be performed. Liquefy starch in 100 mM sodium acetate buffer, pH 4.5 with 100 mM sodium phosphate salts added so that before saccharification, the pH could be adjusted to pH 6.5.

Weigh 5 gram samples of liquefied starch into tared bottles.

Use 0.04% (w/w) Optidex L-400 or approximately 400 mL of 1-10 diluted stock Optidex L-400 per 100 grams of liquefied starch.

Calculate the milligrams of Optidex L-400 contained in the 400 mL of 1-10 diluted stock Optidex L-400. Next, calculate the volume of lysates needed to give the same concentration of enzyme as the Optidex L-400.

Add enzymes to liquefied starch samples and incubate at desired temperature (50°C.). After 18 hours determine DE and prepare a sample for HPLC is analysis.

An exemplary DE Determination:

Exemplary Neocuproine Assay:

A 100 ml sample was added to 2.0 ml of neocuproine solution A (40 g/L sodium carbonate, 16 g/L glycine, 0.45 g/L copper sulfate). To this was added 2.0 ml of neocuproine solution B (1.2 g/L neocuproine hydrochloride-Sigma N-1626). The tubes were mixed and heated in a boiling water bath for 12 minutes; cooled, diluted to 10 ml volume with DI water and the OD read at 450 nm on the spectrophotometer. The glucose equivalent in the sample was extrapolated from the response of a 0.2 mg/ml glucose standard run simultaneously.

Exemplary HPLC Analysis:

Saccharification carbohydrate profiles are measured by HPLC (Bio-Rad Aminex HPX-87A column in silver form, 80° C.) using refractive index detection. Mobile phase is filtered Millipore water used at a flow rate of 0.7 ml/min. Saccharification samples are diluted 1-10 with acidified DI water (5 drops of 6 M HCl into 200 mL DI water) then filtered through a 0.45 mm syringe filter. Injection volume is 20 uL.

Exemplary TLC:

Reaction products were w/d at hourly timepoints and spotted and dried on a TLC plate. The Plate was then developed in 10:90 water:isopropanol and visualized with either a vanillin stain or CAM stain and then heated to show reducible sugars. The liquefied starch was partially hydrolyzed to glucose in cases where activity was observed.

Example 12

Starch Liquefaction Using Amylases of the Invention

This example describes an exemplary method of the invention for liquefying starch using amylases of the invention.

Amylase concentrate was prepared from fermentation broths by heat treatment, cell washing, alkaline extraction using microfiltration and ultrafiltration (48% overall yield). The UF concentrate was neutralized with acetic acid and formulated with 30% glycerol at pH 4.5. The activity level of the slurry formulation was representative of a commercial product (120 $U^1$/g-0.5 kg/ton starch).

Standard Amylase Activity Assay

A 1 mL cuvette containing 950 µL of 50 mM MOPS pH 7.0 containing 5 mM PNP-α-D-hexa-(1→4)-glucopyranoside was placed in the Peltier temperature controller of the Beckman DU-7400 spectrophotometer preheated to 80° C. The spectrophotometer was blanked at 405 nm and 50 µL of the enzyme solution was added to the cuvette, mixed well and the increase in the $OD_{405\ nm}$ was monitored over a one-minute interval. The $\Delta OD_{405\ nm/min}$ rate is converted to a standard unit of µmole/minute from the $OD_{405\ nm}$ response of 50 µL of 1 µmole/mL PNP in 950 mL 50 mM MOPS at pH 7.0-80° C. One standard Diversa unit of thermostable alpha amylase (DTAA) is equal to the amount of enzyme that will catalyze the release of 1 µmole/mL/minute of pNP under the defined conditions of the assay.

Standard Glucoamylase Activity Assay

A 1 mL cuvette containing 950 µL of 50 mM MOPS pH 7.0 containing 5 mM pNP-α-D-glucopyranoside was placed in the Peltier temperature controller of the Beckman DU-7400 spectrophotometer preheated to 60° C. The spectrophotometer was blanked at 405 nm and 50 µL of the enzyme solution was added to the cuvette, mixed well and the increase in the $OD_{405\ nm}$ was monitored over a one-minute interval. The $\Delta OD_{405\ nm/min}$ rate is converted to a standard unit of µmole/minute from the $OD_{405\ nm}$ response of 50 µL of 1 µmole/mL pNP in 950 mL 50 mM MOPS at pH 7.0-60° C. One standard Diversa unit of glucoamylase (DGA) is equal to the amount of enzyme that will catalyze the release of 1 µmole/mL/minute of pNP under the defined conditions of the assay.

Dextrose Equivalent Determination

The neocuproine method was used to measure the DE. Selected samples were measured by both the Invention procedure and by a GPC analyst using the GPC Fehlings procedure.

Neocuproine Assay

A 100 µl sample was added to 2.0 ml of neocuproine solution A (40 g/L sodium carbonate, 16 g/L glycine, 0.45 g/L copper sulfate). To this was added 2.0 ml of neocuproine solution B (1.2 g/L neocuproine hydrochloride-Sigma N-1626). The tubes were mixed and heated in a boiling water bath for 12 minutes; cooled, diluted to 10 ml volume with DI water and the OD read at 450 nm on the spectrophotometer. The glucose equivalent in the sample was extrapolated from the response of a 0.2 mg/ml glucose standard run simultaneously.

The starch sample is diluted ~1 to 16 with DI water with the exact dilution recorded. Ten milliliters of the diluted sample was added to 20 mls of DI water. Ten milliliters of Fehlings solution A and B were added to the diluted starch. The sample was boiled for 3 minutes and cooled on ice. Ten milliliters of 30% KI and 10 ml of 6N $H_2SO_4$ was added. The solution was titrated against 0.1N sodium thiosulfate. The titrant volume is recorded and used to calculate the DE.

Residual Starch Determination

Post-saccharification samples were checked for residual starch using the Staley iodine procedure.

Twenty grams of sample was weighed into a large weigh dish. 45 µL of Iodine solution is added to the weigh dish and the starch solution is mixed well. Dark blue indicates the presence of starch, a light blue-green indicates slight starch, light green indicates a trace of starch and yellow-red, absence of starch. Iodine solution is prepared by dissolving 21.25 grams of iodine and 40.0 grams of potassium iodide in one liter of water.

Oligosaccharide Profile

Liquefaction and saccharification carbohydrate profiles were measured by HPLC (Bio-Rad Aminex HPX-87C column in calcium form −80° C.) using refractive index detection.

Gel Permeation Chromatography

The molecular weight distribution was determined by chromatography on a PL Aquagel-OH column with mass detection by refractive index (Waters Model 2410). A Viscotek Model T60 detector was used for continuous viscosity and light scattering measurements.

Capillary Electrophoresis

Beckman Coulter P/ACE MDQ Glycoprotein System—separation of APTS derivatized oligosaccharides on a fused silica capillary—detection by laser-induced fluorescence.

Primary Liquefaction

Line starch directly from the GPC process is pumped into a 60 liter feed tank where pH, DS (dry solids) and calcium level can be adjusted before liquefaction. The amylase is added to the slurry. The 32% DS slurry is pumped at 0.7 liter/minute by a positive displacement pump to the jet—a pressurized mixing chamber where the starch slurry is instantaneously heated to greater than 100 C by steam injection. The gelatinized partially liquefied starch is pumped through a network of piping (still under pressure) to give the desired dwell time (5 minutes) at temperature. The pressure is released into a flash tank and samples can be taken. Samples were taken in duplicate.

Secondary Liquefaction

The liquefied starch was collected in one liter glass bottles and held in a water bath at 95 C for 90 minutes.

Saccharification

Liquefied starch was cooled to 60 C, the pH adjusted to 4.5 and the samples treated with glucoamylase. Saccharification progress was monitored over time by HPLC.

Saccharification

The liquefied syrups produced with each amylase were adjusted to approximately pH 2.5 with 6N HCl immediately after the 90 minute secondary liquefaction to inactivate any residual amylase. The syrups were then adjusted to pH 4.5, placed in a 60° C. water bath and saccharified with three levels of glucoamylase. The extent of saccharification was monitored by HPLC at 18-88 hour time points.

The liquefied syrups were saccharified with the standard dosage—0.04% of a double-strength glucoamylase—and two lower dosages (50% and 25%) to monitor any differences in the saccharification progress.

| Amylase | 18 hr | 24 hr | 40 hr | 44 hr | 88 hr |
|---|---|---|---|---|---|
| Saccharification Progress - % dextrose development vs time - 0.04% glucoamylase | | | | | |
| Commercial | 70.2 | 78.4 | 86.1 | 86.7 | 94.2 |
| SEQ ID NO: 437 | 79 | 88.6 | 92.5 | 92.8 | 95.3 |
| SEQ ID NO: 6 | 74.1 | 85.9 | 91.9 | 91.6 | 94.8 |
| Saccharification Progress - % dextrose development vs time - 0.02% glucoamylase | | | | | |
| B. licheniformis Amylase | 54.5 | 66.7 | 76.1 | 77.2 | 90.9 |
| SEQ ID NO: 437 | 60.1 | 72 | 84.8 | 85.3 | 93.6 |
| SEQ ID NO: 6 | 57.1 | 70 | 84 | 86.5 | 92.5 |

Post-Saccharification Sugar Profile

In these studies and all previous saccharification studies, the final glucose level achieved after saccharification by amylases of the invention and B. licheniformis in liquefied syrups is essentially identical. The DP2 (maltose) level is also similar. These large fragments are poor substrates for glucoamylase and tend to be converted slowly, if at all, into smaller fragments and ultimately, glucose.

| | Glucose | DP2 | DP3 | >DP7 |
|---|---|---|---|---|
| SEQ ID NO: 437 | 95.25 | 2.39 | 1.13 | 0.91 |
| Commercial | 94.16 | 2.10 | 0.39 | 2.91 |
| SEQ ID NO: 6 | 94.77 | 2.27 | 1.48 | 0.82 |

Molecular Weight Distribution

The molecular weight distribution of syrups liquefied to DE's of 12 and 18 by the exemplary amylases of the invention SEQ ID NO:6 and SEQ ID NO:437, and commercial *Bacillus licheniformis* and commercial *Bacillus stearothermophilus*, were measured by gel permeation chromatography using detection by refractive index, light scattering and viscosity. Both the *B. licheniformis* and *B. stearothermophilus* amylases generate a bimodal distribution—the primary peak centered at 2000, a secondary peak at 32,000 with a shoulder extending past the 160,000 range. The lower molecular weight peak represents approximately 60% of the total mass of the sample. The exemplary amylases of the invention exhibit a single peak at 2000 with very little above 30,000.

HPLC

The DE 12 and 18 syrups produced by the exemplary amylases of the invention SEQ ID NO:6 and SEQ ID NO:437 and commercial *Bacillus licheniformis* and commercial *Bacillus stearothermophilus* amylases were analyzed by HPLC. Both techniques produce fingerprints characteristic of each class of amylase; the oligosaccharide patterns are different for *B. licheniformis* amylase vs *B. stearothermophilus* amylase vs the exemplary amylases of the invention. The liquefied syrups of the invention (e.g., syrups made by methods of the invention and/or made by enzymes of the invention) exhibit evidence of greater branching in the oligosaccharides. HPLC only resolve the oligosaccharides in the <DP 15 range—larger fragments are not visible in these techniques. *Bacillus* amylases are known to liquefy starch in a manner such that the amylopectin fraction is hydrolyzed less extensively than the amylose fraction. These >DP30 amylopectin fragments are contained in the high molecular weight fraction centered at 32,000 and consequently, little evidence of branching is seen in the HPLC analyses of the *Bacillus* liquefied syrups. The <DP15 oligosaccharides from Invention amylases contain fragments from both amylose and amylopectin.

Example 13

Starch Liquefaction at Acidic Conditions Using Amylases of the Invention

The invention provides methods for liquefying starch using amylases of the invention, including amylases active under acidic conditions, e.g., between about pH 4.0 and 5.0, e.g., pH 4.5. The conversion of starch to glucose can be catalyzed by the sequence action of two enzymes: alpha-amylases of the invention to liquefy the starch (e.g., the hydrolysis of high molecular weight glucose polymers to oligosaccharides consisting of 2 to 20 glycose units, typically a dextrose equivalent of 10 to 12, by an amylase of the invention), followed by saccharification with a glycoamylase (which can be a glycoamylase of the invention). In one aspect, processing is in a corn wet milling plant producing a starch slurry having a pH or about 4.0 to 4.5. In one aspect, the pH is raised, e.g., to 5.8 to 6.0 before liquefaction to accommodate an alpha amylase with a low pH activity and stability (which can be an alpha amylase of the invention). In one aspect, amylases of the invention can liquefy starch at pH 4.5 to dextrose equivalents ranging from 12 to 18; in one aspect, using alpha amylases of the invention at levels of about 3 to 6 grams per ton of starch. In this aspect, use of alpha amylases of the invention enables starch liquefaction to be conducted at pH 4.5.

In one aspect, starch liquefaction is conducted at pH 4.5 for 5 minutes at 105° C. to 90 minutes at 95° C. using amylases of the invention. The quantity of enzyme was adjusted in order to adjust a target DE of 12 to 15 after liquefaction. In one aspect, the liquefied starch is then saccharified with a glucoamylase, e.g., an *Aspergillis* glucoamylase, for about 48 hours at about pH 4.5 and 60° C. If the saccharified syrup did not contain at least 95% glucose, the target liquefaction DE was raised and the saccharification repeated until the liquefaction eventually did produce a saccharified syrup containing more than 95% glucose. The amylase protein required to produce a suitable liquefied feedstock for saccharification was determined by PAGE.

Example 14

Starch Liquefaction Using Amylases of the Invention

This example describes an exemplary method for liquefying starch using amylases of the invention and characterizes liquefaction oligosaccharide patterns of the exemplary enzymes of the invention SEQ ID NO:6 and SEQ ID NO:437 (encoded by SEQ ID NO:436) vs commercial *Bacillus licheniformis* and *Bacillus stearothermophilus* amylases. These results compare the saccharification progress and final dextrose levels from syrups generated by enzymes of the invention and commercial amylases.

Three commercial enzymes, Genencor Spezyme AA, and two others all required more than double the recommended dosage to achieve the target Dextrose equivalent (DE). Dextrose equivalent (DE) is the industry standard for measuring the concentration of total reducing sugars, calculated as D-glucose on a dry weight basis. Unhydrolyzed granular starch has a DE of virtually zero, whereas the DE of D-glucose is defined as 100.

These results confirm the "double dosage" effect for all *Bacillus* amylases and gives more credence to the proposal that the observed dosage for SEQ ID NO:437 in the trials is also twice the value which would be required under more normal conditions. The projected "normal" dosage, 60-70 Units/kilo starch at pH 4.5 to reach a 19 DE, is consistent with the laboratory liquefaction data.

The oligosaccharide pattern generated by amylases of the invention is different from the *Bacillus* profiles. The molecular weight distribution for the *Bacillus* amylases (gel permeation chromatography with detection by light scattering and viscosity) is bimodal with a substantial fraction at the very high molecular weight range (>300,000) even at an 18 DE. The SEQ ID NO:437 at 18 DE exhibits a uniform distribution with nothing greater than 20,000. This is consistent with the lower viscosity for syrups of the invention (e.g., syrups made by methods of the invention, or, made using enzymes of the invention). The DP (degrees of polymerization) profiles as measured by HPLC also reflects this difference in action pattern.

In this study, as well as in the previous studies, the final glucose level after saccharification of amylases of the invention liquefied syrups vs the *Bacillus* syrups is the same for both cases. However, saccharification data from, e.g., GPC studies, confirm that the non-dextrose residuals for the amylases of the invention are different from the *Bacillus* amylase syrups. Although the dextrose and maltose levels are essentially the same for both, the amylases of the invention have a higher DP3 fraction but lower amount of the "highers" vs. the *Bacillus* enzyme. Consistent with the absence of high molecular weight fragments after liquefaction, the post saccharification syrups of the invention have a lower content of the >DP7 fraction.

|  | Glucose | DP2 | DP3 | >DP7 |
|---|---|---|---|---|
| SEQ ID NO: 2 | 95.25 | 2.39 | 1.13 | 0.91 |
| Commercial | 94.16 | 2.10 | 0.39 | 2.91 |
| SEQ ID NO: 6 | 94.77 | 2.27 | 1.48 | 0.82 |

SEQ ID NO:437 amylase concentrate was prepared from fermentation broths by heat treatment, cell washing, alkaline extraction using microfiltration and ultrafiltration (48% overall yield). The UF concentrate was neutralized with acetic acid and formulated with 30% glycerol at pH 4.5. The activity level of the slurry formulation was representative of a commercial product (120 U1/g-0.5 kg/ ton starch).

Example 15

Alkaline Amylases for Laundry and Autodishwash Applications

In one aspect, the invention provides detergents comprising amylases of the invention, including amylases active under alkaline conditions, and methods of making and using them.

Three alkali-stable amylase enzymes of the invention were compared to and outperformed a commercial benchmark enzyme with respect to features important in laundry and automatic dishwashing (ADW) applications:

Amylase having a sequence as set forth in SEQ ID NO:212 (encoded by SEQ ID NO:211) outperformed the purified commercial benchmark enzyme in the ADW wash test on starch-coated slides and was very resistant to hydrogen peroxide.

Amylase having a sequence as set forth in SEQ ID NO:210 (encoded by SEQ ID NO:209) and SEQ ID NO:212 (encoded by SEQ ID NO:211) outperformed the purified commercial benchmark enzyme in the presence of a laundry/ADW formulation using a soluble substrate.

In the presence of chelators, amylase having a sequence as set forth in SEQ ID NO:439 (encoded by SEQ ID NO:438) was very stable and amylase having a sequence as set forth in SEQ ID NO:441 (encoded by SEQ ID NO:440) was moderately stable.

Amylase having a sequence as set forth in SEQ ID NO:210 (encoded by SEQ ID NO:209) and amylase having a sequence as set forth in SEQ ID NO:212 (encoded by SEQ ID NO:211) and amylase having a sequence as set forth in SEQ ID NO:441 (encoded by SEQ ID NO:440) have very alkaline pH optima in the range of pH 10 to 11. Amylase having a sequence as set forth in SEQ ID NO:445 (encoded by SEQ ID NO:444) and having a sequence as set forth in SEQ ID NO:439 (encoded by SEQ ID NO:438) have pH optima around 8 while retaining significant activity at pH 10.

Amylase having a sequence as set forth in SEQ ID NO:441 (encoded by SEQ ID NO:440) and having a sequence as set forth in SEQ ID NO:439 (encoded by SEQ ID NO:438) were thermophilic, performing best at 65° to 70° C.

Biochemical Characterization

Five amylases of the invention, three with alkaline pH optima, were characterized for pH optimum and temperature optimum, as described in Table 1. "SEQ ID NOS:209, 210" refers to an amylase having a sequence as set forth in SEQ ID NO:110, encoded by SEQ ID NO:209, etc.

TABLE 1

| Amylase | pH optimum | Temp. optimum (° C.)* |
|---|---|---|
| SEQ ID NOS: 209, 210 | 11 | 55 |
| SEQ ID NOS: 211, 212 | 10 | 50 |
| SEQ ID NOS: 440, 441 | 10 | 70 |
| SEQ ID NOS: 444, 445 | 8 | 40 |
| SEQ ID NOS: 438, 439 | 8 | 65 |

Temperature optima were determined at pH 10 for the amylase having a sequence as set forth in SEQ ID NO:210, encoded by SEQ ID NO:209 ("SEQ ID NOS:209, 210"); SEQ ID NOS:211, 212; and SEQ ID NOS:440, 441 and at pH 8 for SEQ ID NOS:444, 445 and SEQ ID NOS:438, 439.

Figure 19:
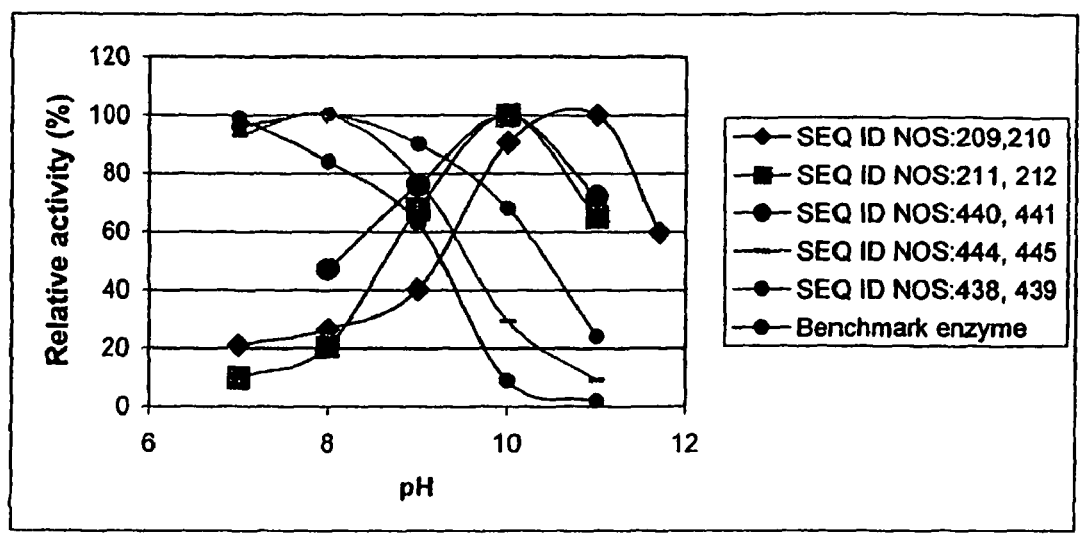
FIG. 19 shows the pH profile of tested amylases of the invention and a commercial benchmark enzyme, as described in Example 15, below.

The pH profiles for amylases of the invention compared to the benchmark enzyme currently used in a commercial laundry/ADW product are presented in FIG. 1. All of the enzymes of the invention demonstrated optimal activity between pH 8 and 10, whereas the commercial benchmark enzyme was most active at pH below 8 and had only residual activity at pH 10. FIG. 19 shows the pH profile of the tested amylases of the invention and the commercial benchmark enzyme. Purified protein was added to buffers of the indicated pH containing soluble substrate and the activity was measured. Initial rates were calculated over 10 min and converted to a percentage of the maximum rate.

Figure 20:
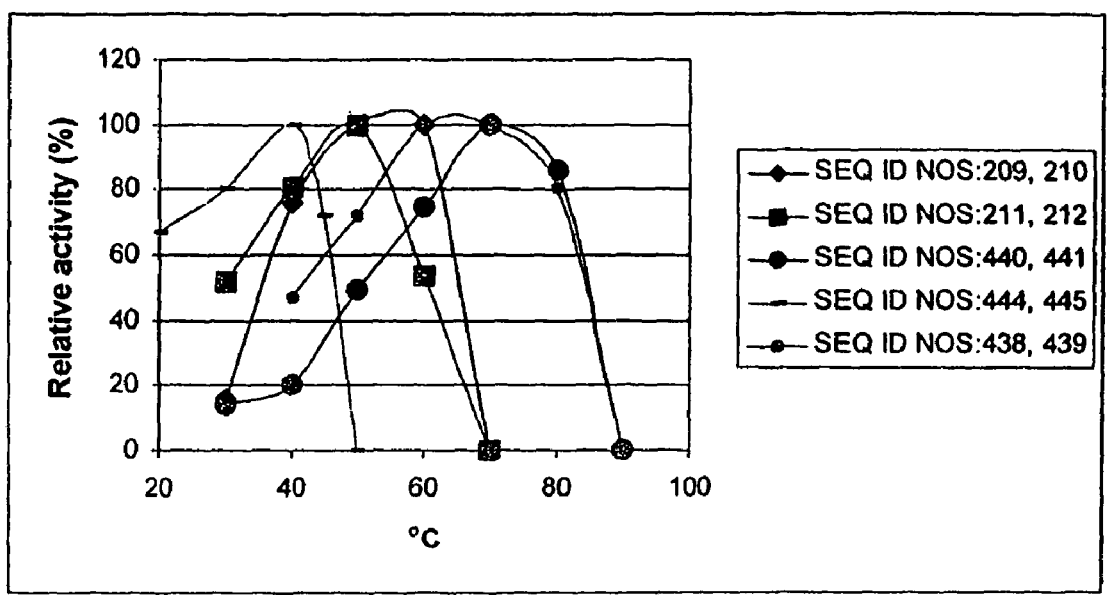
FIG. 20 shows the temperature activity profiles of exemplary amylases of the invention, as described in Example 15, below.

The temperature profiles of enzymes of the invention are presented in FIG. 20. Three were most active between temperatures 45° C. and 55° C., while the amylase having a sequence as set forth in SEQ ID NO:441 (encoded by SEQ ID NO:440) ("SEQ ID NOS:440, 441") and SEQ ID NOS:438, 439 had optimum activity between 60° C. and 70° C. FIG. 20 shows the temperature activity profiles of the tested amylases of the invention. Activity of purified protein was measured at pH 10 (SEQ ID NOS:209, 210, SEQ ID NOS:211, 212, SEQ ID NOS:440, 441) or pH 8 (SEQ ID NOS:444, 445, SEQ ID NOS:438, 439) at the indicated temperature. Activity was measured either by a reducing sugar assay or by monitoring the fluorescence at 520 nm (485 nm excitation) when BODIPY-starch was used. Initial rates were calculated and converted to a percentage of the maximum rate.

Application Testing

Figure 21:
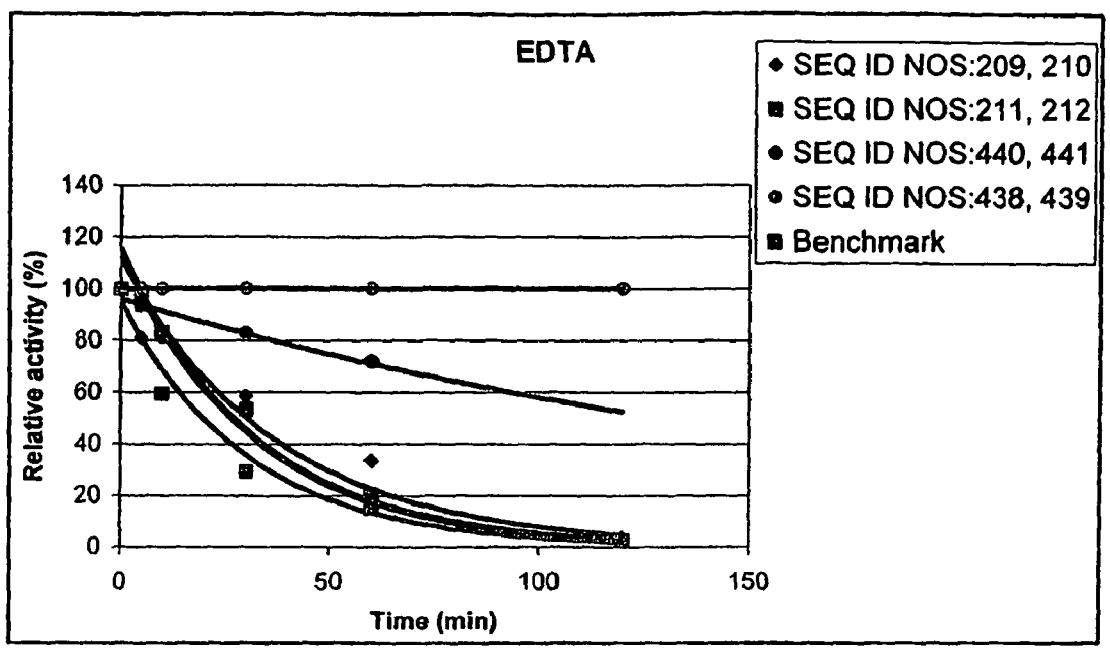
FIG. 21 shows enzyme activity (of exemplary amylases of the invention) in the presence of EDTA, as described in Example 15, below.
Figure 22:
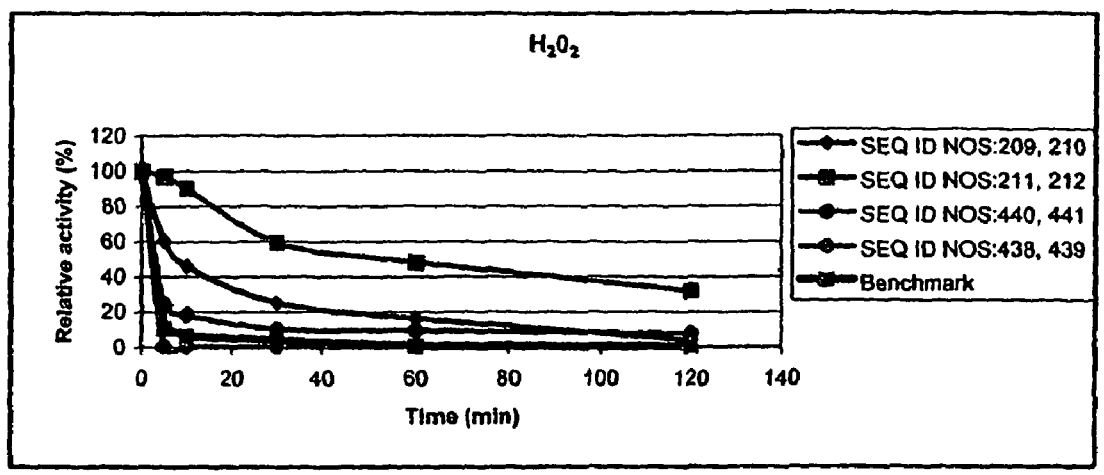
FIG. 22 shows enzyme activity (of exemplary amylases of the invention) in the presence of peroxide hydroxide, as described in Example 15, below.
Figure 23:
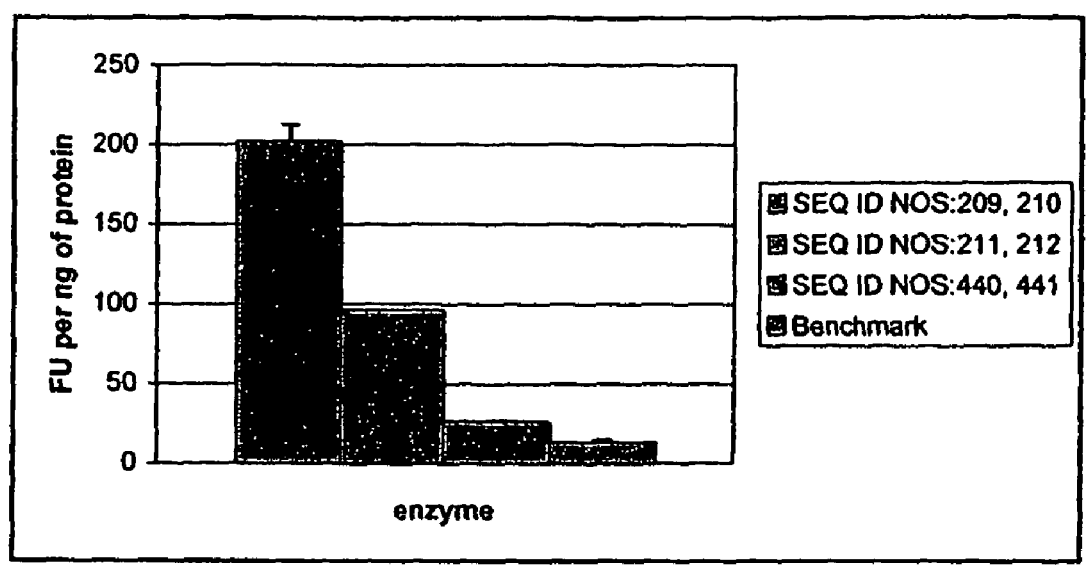
FIG. 23 shows enzyme activity (of exemplary amylases of the invention) in the ADW solution (distilled water, hardening solution, bleach, chelators, surfactants) with soluble substrate (BODIPY-starch), as described in Example 15, below.
Figure 24:
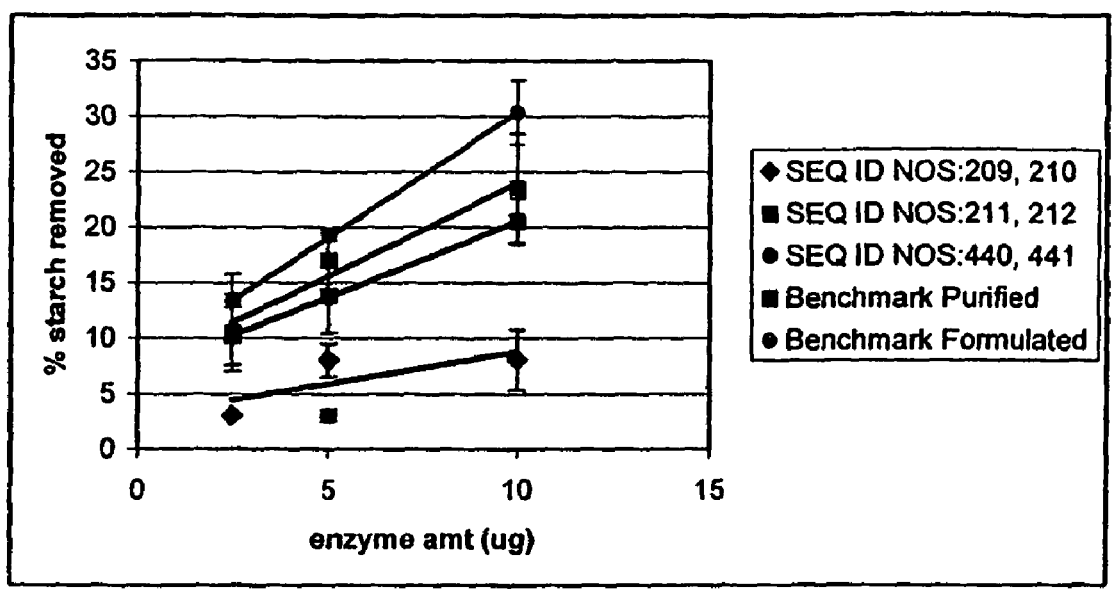
FIG. 24 shows the results of the wash tests with starch-coated slides using exemplary amylases of the invention, as described in Example 15, below.

Experiments were designed to assess the activity and stability of the tested alkaline amylases of the invention in laundry/ADW formulations and with the components individually. FIGS. 21, 22 and 23 present the results of experiments using a soluble starch substrate. FIG. 24 presents results using a solid substrate—the industry—standard starch-coated slides.

Amylase having a sequence as set forth in SEQ ID NO:439 (encoded by SEQ ID NO:438) ("SEQ ID NOS:438, 439") was very resistant to the chelator EDTA (FIG. 21) and SEQ ID NOS:211, 212 displayed significant resistance to hydrogen peroxide (FIG. 22). In contract, the commercial benchmark enzyme was not functional in the presence of either component under the conditions of the experiments. In the presence of the complete laundry/ADW formulation, SEQ ID NOS: 209, 210 and SEQ ID NOS:211, 212 were much more active on soluble substrate than the commercial benchmark enzyme (FIG. 23).

FIG. 21 shows enzyme activity in the presence of EDTA. Purified proteins were incubated at 50° C. in the presence or absence of 5 mM EDTA for the indicated time, after which residual amylase activity was measured using soluble substrate. Activity in the presence of EDTA is expressed as the % of activity in the absence of chelator. FIG. 22 shows enzyme activity in the presence of peroxide hydroxide. Purified proteins were incubated at 50° C. in the presence or absence of 1M $H_2O_2$ for the indicated time after which amylase activity was measured using soluble starch. Activity in the presence of peroxide hydroxide is presented as the % of activity in the absence of $H_2O_2$. FIG. 23 shows enzyme activity in the ADW solution (distilled water, hardening solution, bleach, chelators, surfactants) with soluble substrate (BODIPY-starch). Purified proteins reacted with the soluble starch at 40° C. in the presence of laundry/ADW formulation. Initial rates were calculated over 5 minutes and expressed as fluorescent units (FU)/s per ng of protein.

The lead performers emerging from the tests on soluble substrate were the amylase having a sequence as set forth in SEQ ID NO:210 (encoded by SEQ ID NO:209) ("SEQ ID NOS:209, 210") and SEQ ID NOS:211, 212. These amylases, along with SEQ ID NOS:440, 441, were compared with the commercial benchmark enzyme in the industry-standard wash test on the starch-coated slides. Results of these experiments are presented in FIG. 24. The enzyme having a sequence as set forth in SEQ ID NO:212 (encoded by SEQ ID NO:211) consistently outperformed the purified benchmark enzyme in this test although the formulated benchmark enzyme showed better performance. The nature of the benchmark commercial formulation is unknown, but the purified benchmark enzyme displayed two-fold increase in activity in the presence of Bovine Serum Albumin (BSA). FIG. 24 shows the results of the wash tests with starch-coated slides. Purified proteins were incubated with slides at 50° C. for 30 min in the presence of ADW solution (distilled water, water hardening solution, bleach, chelators, surfactants). Starch removal was measured comparing weight loss after the enzyme treatment to the initial weight of the slide.

Summary of the Characterization of Exemplary Amylases

The gene encoding the amylase having a sequence as set forth in SEQ ID NO:212 (encoded by SEQ ID NO:211) ("SEQ ID NOS:211, 212") was isolated from an environmental library collected from a biotope with a pH of 11.0 and temp of 41° C. The amylase encoded by this gene belongs to Family I and does not contain any known Starch/Carbohydrate Binding Domains. The protein has been expressed with and without a C-terminal histidine tag, and in non-glycosylating and a glycosylating host. Enzyme expressed in all of these Host/His tag combinations have pH optima around 10 and temperature optima around 50° C. (experiments represented by FIGS. 19 and 20). The enzyme expressed in the glycosylating host with a His tag was used for the experiments represented by FIGS. 21 through 24. The presence of the His tag does not seem to affect specific activity, however, glycosylation appears to result in a slightly lower specific activity than that without glycosylation.

In summary:

The best performer in these application assays was the amylase having a sequence as set forth in SEQ ID NO:212 (encoded by SEQ ID NO:211) ("SEQ ID NOS: 211, 212").

pH and temperature optima of SEQ ID NOS:211, 212 meet the requirements for laundry/ADW applications and SEQ ID NOS:211, 212, with proper formulation, should exceed the performance of the commercial benchmark enzyme.

Example 16

Identification and Characterization of a Thermostable Glucoamylase

The following example describes the identification and characterization of an exemplary thermostable amylase of the invention having glucoamylase activity.

Nucleic Acid Extraction: The filamentous fungus *Thermomyces lanuginosus* ATCC 200065 was grown in liquid culture in Potato Dextrose Medium (Difco, BD, Franklin Lakes, N.J.). Biomass was collected and high molecular weight genomic DNA was isolated using DNEASY™ (DNeasy) Plant Maxi Kit (Qiagen, Valencia, Calif.) using standard protocols. Total RNA was also isolated using RNEASY™ (RNeasy) Plant Mini Kit (Qiagen) using standard protocols.

Library Construction: *Thermomyces* genomic DNA was partially digested with restriction enzymes and fragments between 1-10 kb were purified for construction of a genome library. The fragments were ligated into the vector Lambda Zap Express™ (Stratagene, San Diego, Calif.) and packaged into infectable phage as per manufacturer's instructions.

Library Screening: The above lambda library was used to infect XL1 Blue MRF' cells (Stratagene) in top agar. Approximately 50,000 pfu of phage was added to 600 ul of cells OD600=-1. The mixture was incubated at 37° C. for 15 minutes in a water bath and then added to 6 ml melted 0.7% top agar and plated onto NZY agar plates. The plate was then incubated overnight at 39° C. A nylon circle (F. Hoffmann-La Roche Ltd., Basel Switzerland) was laid on top of the resulting plaque lawn and lifted back up with some of the phage adhering to the nylon. The nylon was submerged in 1.5M NaCl, 0.5M NaOH for 2 minutes, 1.5M NaCl, 0.5M Tris pH 7.6 for 5 minutes and 2×SSC, 0.2M Tris pH7.6 for 30 seconds. The nylon filter was then UV crosslinked in a Stratagene crosslinker.

A 639 bp PCR fragment from the glucoamylase gene of *Aspergillus niger* was generated from *Aspergillus* genomic DNA for use as a probe. The primers (5'-GCGACCTTGGAT-TCATGGTTGAGCAAC-3' (SEQ ID NO:595) and 5'-CA-CAATAGAGACGAAGCCATCGGCGAA-3') (SEQ ID NO:596) were used in the PCR reaction that utilized the Expand High Fidelity PCR Kit™ (Roche) using 30 cycles of 95° C. for 20 seconds, 55° C. for 30 seconds, and 72° C. for 1 minute in a thermal cycler. This PCR fragment is composed of exons 1-4 of the *Aspergillus* glucoamylase gene. The isolated PCR fragment was prepared as a radioactive probe using the Prime It Kit™ (Stratagene) following manufacturer's instructions.

The library filter lifts were washed in a prehybridization solution (DIG Easy Hyb™, Roche) for two hours at 42° C. in a hybridization oven (Robbins). The probe was added to 15 ml fresh DIG Easy Hyb™ and used to replace the prehybridization solution. The filter was washed with probe overnight at 45° C. The probe was then removed and the filter washed once with 2×SSC, 0.1% SDS for 15 minutes, and twice with 0.1×SSC, 0.1% SDS for 15 minutes each. The nylon filter was then exposed to x-ray film overnight at −80 C. Following developing, hybridization spots on the x-ray film were used to identify clones from the original plate. An agar plug was taken from the plate where the spots lined up and suspended in SM buffer to release the phage into solution. Several isolated plaques corresponding to *Thermomyces* genomic fragments containing all or part of the glucoamylase gene were thus isolated.

100 ul of isolated phage stock was added to 200 ul XL-1 Blue MRF' cells (Stratagene) and 1 ul ExAssist™ helper phage (Stratagene). The mixture was incubated at 37 C for 15 minutes, and 3 ml of 2×YT media was added. This was then incubated at 37° C. with shaking for 2.5 hours. The mix was then heated for 20 minutes at 70° C. and cooled on ice. 100 ul of the mix was removed and added to 200 ul SOLR cells (Stratagene) and incubated at 37 C for 15 minutes. 50 ul was plated on LB kanamycin (50 ug/ml) plates and incubated overnight at 37° C. Resulting colonies contain cloned genomic fragments in the plasmid pBK-CMV.

Sequencing: DNA sequencing on candidate clones were performed with the BigDye Terminator Cycle Sequencing Version 2.0 Kit™ (Applied Biosystems, Foster City, Calif.) and a 3700 DNA Analyzer™ (Applied Biosystems) using manufacturer's protocols. A genomic clone was identified with a 4.1 kb insert that contained the entire glucoamylase gene and flanking sequence, as set forth in SEQ ID NO:587. Potential introns were identified by comparing this sequence with consensus sequences for introns in *Aspergillus*. The *Thermomyces lanuginosus* nucleotide sequence has an open reading frame encoding a protein of 617 amino acids, interrupted by four introns of 64 bp, 61 bp, 80 bp, and 57 bp respectively.

cDNA Synthesis: The primers 5'-ATGTTATTCCAAC-CGACTTTGTGCGC-3' (SEQ ID NO:597) and 5'-TCATCGCCACCAAGAATTCACGGTG-3' (SEQ ID NO:598) were used in a cDNA synthesis reaction using a Thermoscript rtPCR Kit™ (Invitrogen) using manufacturer's protocols. The template for synthesis was total RNA isolated from *Thermomyces lanuginosus* cells growing on potato dextrose media (Difco). An 1854 bp fragment from the reaction was isolated, cloned and sequenced, with the nucleic acid sequence set forth in SEQ ID NO:593.

Expression Cloning: Primers were designed for overexpression of Thermomyces glucoamylase in the host *Pichia pastoris*. The primers 5'-GTCTCGAGAAAAGAG-CAACGGGCTCGCTCGAC-3' (SEQ ID NO:599) and 5'-GTTCTAGATCATCGCCACCAAGAATTCACGGT-3' (SEQ ID NO:600) were used to generate a PCR fragment using the cDNA clone as a template using 30 cycles of 95° C. for 20 seconds, 55° C. for 30 seconds, 72° C. for 2 minutes, using Expand High Fidelity PCR Kit™ (Roche) and manufacturer's protocols. The PCR fragment was digested with the restriction enzymes Xho I and Xba I and ligated into the corresponding restriction sites of the plasmid pPIC Z alpha (Invitrogen). The construct was transformed into *Pichia pastoris* Strain X-33 (Invitrogen) where the construct integrates stably into the *Pichia* chromosome. Selection was based on resistance to zeocin. This construct was designed such that the *Pichia* clone can be induced with methanol to secrete the mature *Thermomyces* glucoamylase into the media.

A 1-liter culture of the *Pichia* expression clone was inoculated with an overnight starter culture in BMGY and grown overnight at 30° C. in a shake flask. The cells were collected by centrifugation the following day and resuspended in 1 liter of BMMY. The cells were cultured at 30° C. in a shake flask for 3 days with methanol added to 0.5% final every 24 hours.

The media containing the expressed glucoamylase enzyme was then collected and tested in a glucoamylase activity assay and SDS PAGE electrophoresed using standard protocols to determine the protein size.

Primers were also designed for overexpression of the *Thermomyces* glucoamylase gene in *Escherichia coli*. The primers (SEQ ID NO:601) 5'-GTCCATGGCAACGGGCTCGCTC-GAC-3' and (SEQ ID NO:602) 5'-GTTCTAGATCATCGC-CACCAAGAATTCACGGT-3' were used to generate a PCR product as before, from the cDNA template. The PCR fragment was digested with the restriction enzymes NcoI and XbaI and ligated into corresponding restriction sites of the plasmid pSE420 (Invitrogen). The construct was transformed into *Escherichia coli* Strain XL-1 Blue MR (Stratagene). Selection for the plasmid was based on ampicillin resistance. The glucoamylase gene is under the control of the lac-z promoter in this plasmid vector and is induced with IPTG (isopropyl-thio-galactopyranoside). The construct was designed such that the mature glucoamylase gene will be expressed within the *Escherichia* cell and will contain an extra methionine residue at the N-terminus.

Standard assay: Enzyme aliquots were added to a solution of 5 mM buffer, 3 mM malto-oligosaccharides (Sigma, M-3639) in a waterbath. 100 ul aliquots removed at time points to 200 ul glucose oxidase reagent (Sigma, GAGO-20) and incubated 37° C., 30 min. The reaction was stopped with addition of 12 N sulfuric acid and the absorbance at 540 nm determined. The full-length version of the enzyme (SEQ ID NO:594) was tested for pH, temperature and substrate utilization. As noted below, data demonstrated that the pH optimum to be around pH 5.5. Data demonstrated that the enzyme (SEQ ID NO:8) is stable at 70° C. with a rapid irreversible loss of activity between 70° C. and 75° C. Data demonstrated that the enzyme (SEQ ID NO:594) hydrolyses oligosaccharides down to maltose with the rate of hydrolysis being higher for longer saccharides. The rate in cleaving 1,6 linkages is much slower than 1,4 as observed in the substrate panose which has a 1,6 linkage at the non-reducing end. The catalytic domain version appears to be less thermostable. The enzyme (SEQ ID NO:594) has a good rate of hydrolysis at 50° C. but appears to die at 70° C.

Activity Assay: Enzyme (SEQ ID NO:594) activity was measured by the release of free glucose from an oligo-dextrin substrate. The liberated glucose was then oxidized in a coupled reaction resulting in a colored product. An enzyme (SEQ ID NO:594) aliquot added to solution of 5 mM buffer, 3 mM malto-oligosaccharides (Sigma, M-3639) in a water bath. 100 ul aliquots removed at time points to 200 ul glucose oxidase reagent (Sigma, GAGO-20) and incubated 37° C., 30 min. The reaction was stopped with addition of 12 N sulfuric acid and the absorbance at 540 nm determined. Time points were then plotted to determine the relative rate for the reaction.

pH Profile: Acetate buffer (pH 4.0, 4.5, 5.0, and 5.4) as well as phosphate buffer (pH 6.2, 7.0, 8.1) were used in an activity assay to determine the relative rate for the glucoamylase (SEQ ID NO:594) at each pH. The rates were then plotted, as illustrated in FIG. 5. The enzyme (SEQ ID NO:594) appears to have maximal activity around pH 5.5.

Temperature Profile: The relative rate of the enzyme (SEQ ID NO:594) at various temperatures (50° C., 60° C., 70° C., 80° C., and 85° C.) was determined in acetate buffer pH 5.3. The rates are plotted in FIG. 6. The enzyme (SEQ ID NO:594) appears to have maximal activity at 70° C., above which there is a rapid loss of activity.

Temperature Stability Data: Enzyme (SEQ ID NO:594) was added to 5 mM acetate buffer at the indicated temperature. Enzyme (SEQ ID NO:594) aliquots were removed to ice at 4 minute intervals. The aliquots were then tested for activity on substrate for 20 minutes at 70° C., and the data is illustrated in FIG. 7.

Figure 8:
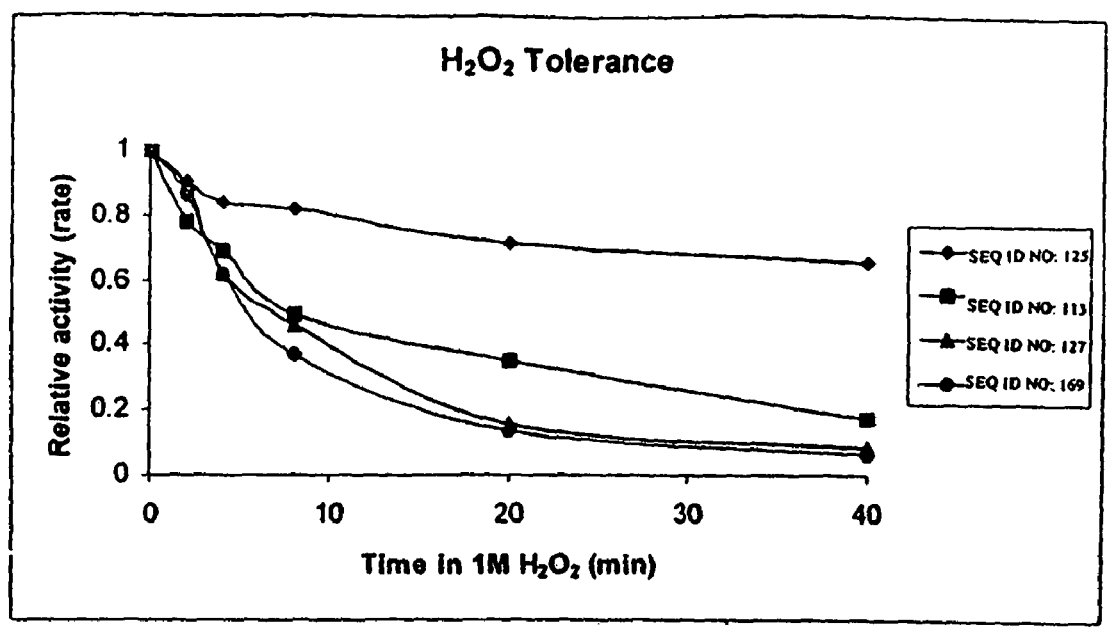
FIG. 8 is a graph of data regarding the $H_2O_2$ tolerance of the novel enzymes in Example 4.
Figure 9A:
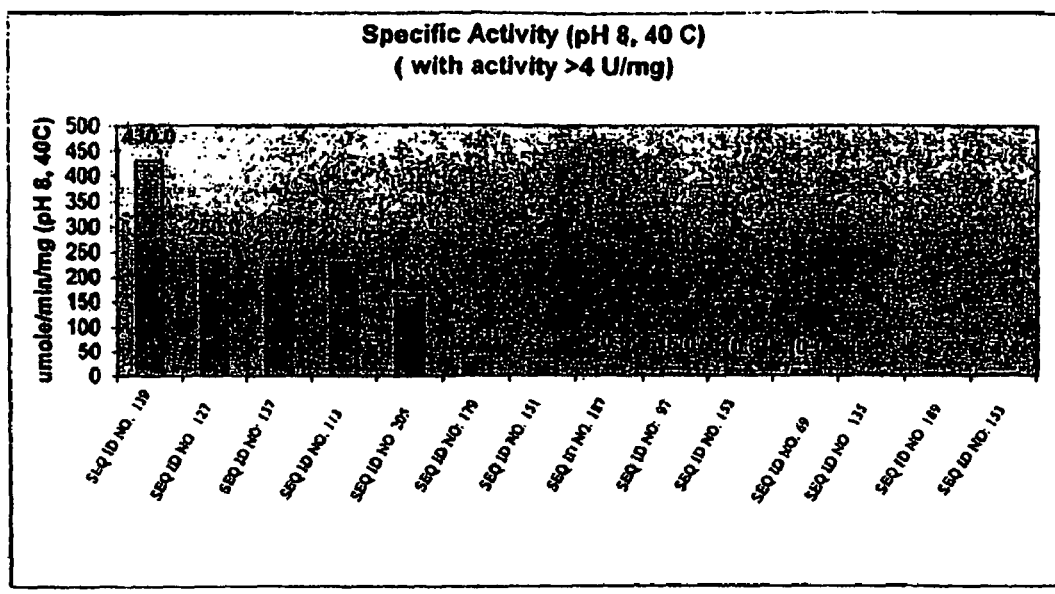
FIG. 9a shows the data at pH 8 and 40° C.
Figure 9B:
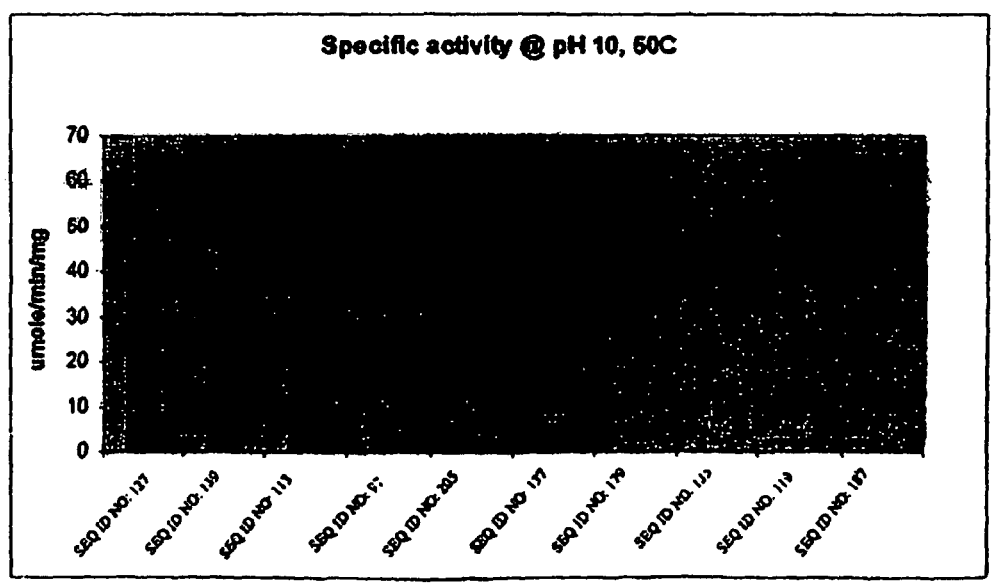
FIG. 9b shows the data at pH 10 and 50° C.

Substrate Utilization: The dextrins maltose (G2), maltotriose (G3), panose (Pan), maltotetraose (G4), and maltoheptaose (G7), were substituted for the malto-oligosaccharides in the activity assay to test for substrate utilization of the glucoamylase (SEQ ID NO:594). Rate of glucose release for various substrates tested in 5 mM acetate buffer, 70° C. Substrates tested: maltose, maltotriose, panose, maltotetraose, and maltoheptaose, were all at 3 mM. The assay was then plotted in FIG. 8. Then enzyme (SEQ ID NO:594) was able to hydrolyze straight-chain (1,4 linkages) dextrins down to maltose with a higher rate for the longer dextrins. The enzyme (SEQ ID NO:594) demonstrated low activity on 1,6 linkages as demonstrated by the substrate panose.

Example 17

Glucoamylase Activity Assay: BCA Reducing Ends Assay

The following example describes an exemplary method for determining if a polypeptide is within the scope of the invention, for example, by a BCA reducing ends assay. Glucoamylase activity can be determined using the following methodology.

1. Prepare 2 substrate solutions, as follows:
   a) 2% soluble starch (potato) pH 8 solution by dissolving 2 gm potato starch in 100 ml 100 mM sodium phosphate pH 8).
   b) 2% soluble starch (potato) pH 10 solution by dissolving 2 gm potato starch in 100 ml 100 mM sodium carbonate.

Heat both solutions in a boiling water bath, while mixing, for 30-40 minutes until starch dissolves.

2. Prepare Solution A from 64 mg/ml sodium carbonate monohydrate, 24 mg/ml sodium bicarbonate and 1.95 mg/ml BCA (4,4'-dicarboxy-2,2'-biquinoline disodium salt (Sigma Chemical cat # D-8284). Added above to $dH_2O$.

3. Prepare solution B by combining 1.24 mg/ml cupric sulfate pentahydrate and 1.26 mg/ml L-serine. Add mixture to $dH_2O$.

4. Prepare a working reagent of a 1:1 ration of solutions A and B.

5. Prepare a Maltose standard solution of 10 mM Maltose in $dH_2O$, where the 10 mM maltose is combined in 2% soluble starch at desired pH to a final concentration of 0, 100, 200, 300, 400, 600 µM. The standard curve will be generated for each set of time-points. Since the curve is determined by adding 10 ul of the standards to the working reagent it works out to 0, 1, 2, 3, 4, 6 nmole maltose.

6. Aliquot 1 ml of substrate solution into microcentrifuge tubes, equilibrate to desired temperature (5 min) in heat block or heated water bath. Add 50 ul of enzyme solution to the inside of the tube lid.

7. While solution is equilibrating mix 5 ml of both solution A & B. Aliquot 100 ul to 96 well PCR plate. Set plate on ice.

8. After 5 minute temperature equilibration, close lid on tubes, invert and vortex 3 times. Immediately aliquot 10 ul into plate as t=0 (zero time point). Leave enzyme mixture in heat block and aliquot 10 ul at each desired time point (e.g. 0, 5, 10, 15, 20, 30 minutes).

9. Ensure that 12 wells are left empty (only working reagent aliquotted) for the addition of 10 ul of standards, for the standard curve.

10. When all time points are collected and standards are added, cover plate and heated to 80° C. for 35 min. Cool plate on ice for 10 min. Add 100 ul H2O to all wells. Mix and aliquot 100 ul into flat bottomed 96-well plate and read absorbance at 560 nm.

11. Zero each sample's time points against its own t=0 (subtract the average t=0 A560 value from other average A560 values). Convert the $A560_{(experimental)}$ to umole (Divide $A560_{(experimental)}$ by the slope of the standard curve (A560/umole). Generate a slope of the time points and the umole (in umole/min), multiply by 100 (as the umole value only accounts for the 10 ul used in the assay, not the amount made in the 1 ml rxn). To get the specific activity divide the slope (in umole/min) by the mg of protein. All points should be done at a minimum in duplicate with three being best. Divide protein concentration (mg/ml) by any dilution to get mg used in assay. Divide the above slope by mg used in assay to get specific activity. See for example, Wong (2000) J. Agric. Food Chem. 48:4540-4543; Fox (1991) Anal. Biochem. 195, 93-96.

Example 18

Screening for Glucoamylase Activity

The following example describes an exemplary method for determining if a polypeptide is within the scope of the invention. Glucoamylase activity of clones can be assessed by a number of methods known in the art. The following is the general methodology that can be used.

The number of plaques screened, per plate, can be approximately 10,000 pfu's. For each DNA library: about 50,000 plaques per isolated library and 200,000 plaques per non-isolated library can be screened depending upon the pfu titer for the λ Zap Express amplified lysate.

Titer Determination of Lambda Library

8) μL of Lambda Zap Express amplified library stock added to 600 μL E. coli MRF' cells ($OD_{600}$=1.0). To dilute MRF' stock, 10 mM $MgSO_4$ is used.
9) Incubate at 37° C. for 15 minutes.
10) Transfer suspension to 5-6mL of NZY top agar at 50° C. and gently mix.
11) Immediately pour agar solution onto large (150 mm) NZY media plate.
12) Allow top agar to solidify completely (approximately 30 minutes), then invert plate.
13) Incubate the plate at 39° C. for 8-12 hours.
14) Number of plaques is approximated. Phage titer determined to give 10,000 pfu/plate. Dilute an aliquot of Library phage with SM buffer if needed.

Substrate Screening

13) Lambda Zap Express (50,000 pfu) from amplified library added to 600 μL of E. coli MRF' cells (OD600-1.0). For non-environment libraries, prepare 4 tubes (50,000 pfu per tube).
14) Incubate at 37° C. for 15 minutes.
15) While phage/cell suspension are incubating, 1.0 mL of red starch substrate (1.2% w/v) is added to 6.0 mL NZY top agar at 50° C. and mixed thoroughly. Keep solution at 50° C. until needed.
16) Transfer ⅕ (10,000 pfu) of the cell suspension to substrate/top agar solution and gently mixed.
17) Solution is immediately poured onto large (150 mm) NZY media plate.
18) Allow top agar to solidify completely (approximately 30 minutes), then invert plate.
19) Repeat procedures 4-6 four times for the rest of the cell suspension (⅕ of the suspension each time).
20) Incubate plates at 39° C. for 8-12 hours.
21) Plate observed for clearing zones (halos) around plaques.
22) Plaques with halos are cored out of agar and transferred to a sterile micro tube. A large bore 200 μL pipette tip works well to remove (core) the agar plug containing the desired plaque.
23) Phages are re-suspended in 500 μL SM buffer. 20 μL Chloroform is added to inhibit any further cell growth.
24) Pure phage suspension is incubated at room temperature for 4 hours or overnight before next step.

Isolation of Pure Clones 12) 10 μL of re-suspended phage suspension is added to 500 μL of E. coli MRF' cells (OD600=1.0).
13) Incubate at 37° C. for 15 minutes.
14) While phage/cell suspension is incubating, 1 mL of red starch substrate (1.2% w/v) is added to 6.0 mL NZY top agar at 50° C. and mixed thoroughly. Keep solution at 50° C. until needed.
15) Cell suspension is transferred to substrate/top agar solution and gently mixed.
16) Solution is immediately poured onto large (150 mm) NZY media plate.
17) Allow top agar to solidify completely (approximately 30 minutes), then invert plate.
18) Plate incubated at 39° C. for 8-12 hours.
19) Plate observed for a clearing zone (halo) around a single plaque (pure clone). If a single plaque cannot be isolated, adjust titer and re-plate phage suspension.
20) Single plaque with halo is cored out of agar and transferred to a sterile micro tube. A large bore 200 μL pipette tip works well to remove (core) the agar plug containing the desired plaque. To amplify the titer, core 5 single active plaques into a micro tube.
21) Phages are re-suspended in 500 μL SM buffer. 20 μL Chloroform is added to inhibit any further cell growth.
22) Pure phage suspension is incubated at room temperature for 4 hours or overnight before next step. The pure phage suspension is stored at −80° C. by adding DMSO into the phage suspension (7% v/v).

Excision of Pure Clone 17) 100 μL of pure phage suspension is added to 200 μL E. coli MRF' cells (OD600=1.0). To this, 1.0 μL of ExAssist helper phage (>1×106 pfu/mL; Stratagene) is added. Use 2059 Falcon tube for excision.
18) Suspension is incubated at 37° C. for 15 minutes.
19) 3.0 mL of 2× YT media is added to cell suspension.
20) Incubate at 30° C. for at least 6 hours or overnight while shaking.
21) Tube transferred to 70° C. for 20 minutes. The phagemid suspension can be stored at 4° C. for 1 to 2 months.
22) 100 μL of phagemid suspension transferred to a micro tube containing 200 μL of E. coli Exp 505 cells (OD600=1.0).
23) Suspension incubated at 37° C. for 15 minutes.
24) 300 μL of SOB is added to the suspension.
25) Suspension is incubated at 37° C. for 30 to 45 minutes.
26) 100 μL of suspension is transferred to a small (90 mm) LB media plate containing Kanamycin (LB media with Kanamycin 50 μg/mL) for Zap Express DNA libraries or Ampicillin (LB media with Kanamycin 100 μg/mL) for Zap II DNA libraries.
27) The rest of suspension is transferred to another small LB media plate.
28) Use sterile glass beads to evenly distribute suspension on the plate.
29) Plates are incubated at 30° C. for 12 to 24 hours.

30) Plate observed for colonies.
31) Inoculate single colony into LB liquid media containing suitable antibiotic and incubate at 30° C. for 12 to 24 hours.
32) Glycerol stock can be prepared by adding 80% glycerol into liquid culture (15% v/v) and stored at −80° C.

Activity Verification 7) 50 μL of liquid culture is transferred to a micro tube. Add 500 μL of 8% pH7 Amylopectin Azure into the same tube. Prepare 2 tubes for each clone.
8) Activity is tested at 50° C. for 3 hours and overnight. Use pH 7 buffer as control.
9) Cool the test specimen at ice-water bath for 5 minutes.
10) Add 750 μL of Ethanol and mixed thoroughly.
11) Centrifuge at 13000 rpm (16000 g's) for 5 minutes.
12) Measure OD of the supernatant at 595 nm.

RFLP Analysis 13) 1.0 mL of liquid culture is transferred to a sterile micro tube.
14) Centrifuge at 13200 rpm (16000 g's) for 1 minute.
15) Discard the supernatant. Add another 1.0 mL of liquid culture into the same sterile micro tube.
16) Centrifuge at 13200 rpm (16000 g's) for 1 minute.
17) Discard the supernatant.
18) Follow QIAprep spin mini kit protocol for plasmid isolation.
19) Check DNA concentration using BioPhotometer.
20) Use Sac I and Kpn I for first double digestion. Incubate at 37° C. for 1 hour.
21) Use Pst I and Xho I for second double digestion. Incubate at 37° C. for 1 hour.
22) Add Loading dye into the digested sample.
23) Run the digested sample on a 1.0% agarose gel for 1-1.5 hours at 120 volts.
24) View gel with gel imager. All clones with a different digest pattern will be sent for sequence analysis.

Example 19

Assay for Glucoamylases

The following example describes an exemplary method for determining if a polypeptide is within the scope of the invention.

Preparation of Host Cultures

5. Start an overnight culture of XL1-Blue MRF' host cells. Use a single colony from a streak plate to inoculate 10 mL LB supplemented with 20 ug/mL tetracycline. Grow overnight culture shaking at 37° C. for at least 16 hours.
6. Using aseptic technique, inoculate a fresh 100 mL of LBTet day culture with XL1-Blue MRF' host from the overnight $LB_{Tet}$ culture.
7. Grow in a 37° C. shaker until the OD reaches 0.75-1.0.
8. Pellet host cells at 1000×g for 10 minutes and gently resuspend in 10 mM $MgSO_4$ at OD5.
9. Dilute a small amount of host cells to OD1 for use in titering and pintooling.
10. Host preparations can be used for up to 1 week when stored on ice or at 4° C.
   To shorten growth time for the day culture, use ½× the usual Tet concentration in LB (½=10 ug/mL), or omit the antibiotic altogether.
   Do not use NZY when selecting with Tetracycline. The high $Mg^{++}$ concentration in NZY medium renders Tet inactive.

Titering Lambda Libraries

11. Place three sterile microfuge tubes in a rack.
12. Aliquot 995 uL prepared host cells in one tube and 45 uL prepared OD1 host cells into each of the two remaining tubes.
13. Add 5 uL of lambda library to the tube containing 995 uL host cells and mix by vortexing. This results in a dilution factor of 200.
14. Prepare ½,000 and ½0,000 dilutions by consecutively adding 5 uL of previous dilution to the remaining two tubes containing 45 uL prepared host cells. Mix by vortexing after each dilution was made.
15. Allow phage to adsorb to host by incubating at 37° C. for 15 minutes.
16. Meanwhile, pipet 100 uL of prepared OD1 host cells to each of three Falcon 2059 tubes.
17. Add 5 uL of each dilution to a separate 2059 tube containing host cells.
18. Plate each by adding 3 mL top agar to each tube and quickly pour over 90 mm NZY plates. Ensure a smooth, even distribution before the top agar hardens.
19. Invert plates and incubate at 37° C. overnight.
20. Count plaques and calculate titer of the library stock (in plaque forming units (pfu) per uL).

Lambda Microtiter Screening for Glucoamylases

Preparation

5. Prepare a sufficient amount of XL1-Blue MRF' host culture, as described above, for the amount of screening planned. A culture of 100 mL is usually sufficient for screening 2-3 libraries.
6. Autoclave several bottles compatible with the QFill2 dispenser. These are the wide-mouth Corning bottles, 250 mL containing a sealing ring around the lip.
7. Make sure there are sufficient amounts of plates, top agar, BODIPY starch, red starch solution, etc. available for the screen.
8. Schedule the Day 2 robot run with a representative from Automation.

Day 1

10. Label the 1536-well plates (black) with library screen and plate number. Tough-Tags™ tube stickers, cut in half width-wise, are ideal for labeling 1536 well plates.
11. Calculate volumes of library, host cells and NZY medium necessary for the screen. This is easily done with an Excel spreadsheet.
12. Combine the calculated volumes of lambda library and OD5 host cells in a sterile 250 mL wide-mouth Corning bottle (containing a sealing ring).
13. Allow adsorption to occur at 37° C. for 15 minutes.
14. Add the calculated volume of NZY medium and mix well. This is referred to as the cell-phage-medium suspension.
15. Perform a concomitant titer by combining 50 uL of the cell-phage-medium suspension with 250 uL of OD1 host cells in a Falcon 2059 tube, then plating with 9 mL of top agar onto a 150 mm NZY plate. Incubate concomitant titer plate at 37° C. overnight.
16. Load the dispenser with the remainder of the suspension and array each labeled 1536-well plate at 4 uL per well. If the dispenser leaves air bubbles in some wells, they can be removed by centrifuging the plates at 200×g for 1 minute.
17. Add 0.5 uL of positive control phage to well position AD46 of at least two of the assay plates. Use a strong glucoamylase-positive lambda clone for this purpose.

The lambda versions of SEQ ID NO.: 113 or SEQ ID NO.: 199 are good choices for positive controls.

18. Incubate assay plates at 37° C. overnight in a humidified (≧95%) incubator.

Day 2

21. Count the pfu on the concomitant titer plate and determine the average seed density per well (in pfu per well).
22. Pintool at least 2 plates of each library screen (preferably the 2 containing positive controls) as follows:
    a) Prepare 2 host lawn plates to act as a surface on which to pintool: combine 250 uL of OD1 host cells with 2 mL 2% red starch and plate with 9 mL top agar onto 150 mm NZY plates. Hold each plate as level as possible as the top agar solidifies in order to produce an even hue of red across the plate.
    b) Using a twice flame-sterilized 1536 position pintool, replicate at least 2 of the screening plates onto the host lawn plates.
    c) Place the pintooled recipient plates in a laminar flow hood with the lids off for about 15-30 minutes (to vent off excess moisture).
    d) Replace the lids and incubate inverted at 37° C. overnight.
23. Prepare the 2× BODIPY starch substrate buffer as follows:
    a) Calculate the total volume of 2× substrate buffer solution needed for all screening plates at 4 uL per well (including any extra deadspace volume required by the dispenser) and measure this amount of 100 mM CAPS pH 10.4 into a vessel appropriate for the dispenser used.
    b) Retrieve enough 0.5 mg tubes of BODIPY starch to produce the required volume of 2× substrate buffer [calculated in step a) above] at a final concentration of 20-30 ug/mL.
    c) Dissolve each 0.5 mg tube in 50 uL DMSO at room temperature, protected from light, with frequent vortexing. This takes more than 15 minutes; some production lots of BODIPY starch dissolve better than others.
    d) Add 50 uL 100 mM CAPS buffer pH 10.4 to each tube and mix by vortexing.
    e) Pool the contents of all tubes and remove any undissolved aggregates by centrifuging for 1 minute at maximum speed in a microfuge.
    f) Add the supernatant to the rest of the 100 mM CAPS buffer measured in step a) above.
    g) Protect the 2× substrate buffer from light by wrapping in foil.
24. Take plates and substrate buffer to the automation room and program the robot with the following parameters:
    a) dispense 4 uL substrate buffer per well
    b) $1^{st}$ read at 1 hour post-substrate, $2^{nd}$ read at 9 hours, and third read at 17 hours; with 37° C. incubation between reads
    c) excitation filter: 485 nm; emission filter: 535 nm
    d) set the Spectrafluor gain at 70, or the optimal gain for the batch of 2× substrate buffer prepared.
    e) ensure that the incubator used will protect assay plates from light.

Day 3

4. Check pintooled plates for clearings in the bacterial lawn at all positions corresponding to wells on the associated assay plate. Also check for clearings in the red starch in any of the pin positions. If plates containing positive controls were used for pintooling, you should be able to see a large clearing zone in the red background. Be wary of contaminants that also form clearing zones in red starch (see comment "Contaminants That Form Clearing Zones in Red Starch").
5. Identify putative hits from the data file produced by the robot computer. The KANAL program produced by Engineering simplifies data analysis. As a rule of thumb, a putative hit is characterized as a well having signal intensity rising at least 1.5 fold over background.
6. For each putative, remove 2 uL from the well and add to a tube containing 500 uL SM buffer and 50 uL CHCl3. Vortex to mix and store at 4° C. This solution will be referred to hereafter as the 4e-3 stock. The original screening plates should be stored at 4° C., protected from light, at least until breakouts are complete.

This is the recommended method of breaking out putative hits. It is a liquid phase assay that relies on confirmation of activity on BODIPY starch. Alternatively, putative hits can be plated directly onto solid phase plates containing red starch such that 2,000-3,000 pfu per hit are examined for clearing zones. However, inability to observe clearing zones on red starch is not necessarily an indication that a putative hit was a false positive. It would then need to be assayed using the format in which it was originally identified (i.e., liquid phase using BODIPY starch as substrate). In addition, very weak positives are more easily identified using the method detailed below.

Day 1

25. In a sterile 50 mL conical tube, combine 0.5 mL OD5 host cells with 45.5 mL NZY. This will be referred to as the host-medium suspension.
26. For each putative hit to be analyzed, aliquot 1 mL of host-medium suspension into each of 3 three sterile microfuge tubes.
27. Set the 12-channel pipetman in multidispense mode with an aliquot size of 20 uL and an aliquot number of 2×. Mount the pipetman with a clean set of sterile tips.
28. Pour about 1 mL of host-medium suspension into a new sterile solution basin and load the multichannel pipetman.
29. Dispense 20 uL per well into the last row (row P) of a black 384-well plate (12 channels×2=24 wells). This row will be used later for the controls.
30. Expel the remaining liquid in the tips by touching the tips against the surface of the basin and pressing the RESET button on the pipetman. Lay the pipetman down in a way to prevent contamination of the tips. There is no need to change the tips at this point.
31. Pour the remainder of the fluid in the basin into a waste container (like a beaker) taking care to avoid splashback contamination.
32. For the first putative to be analyzed, take 111 uL of the 4e-3 stock (see Day 2 in *Lambda Microtiter Screening for glucoamylases*) and add it to the first in a set of three tubes containing 1 mL host-medium suspension (step 2). Vortex to mix. This is Dilution A.
33. Take 111 uL of Dilution A and add to the next tube in the set. Vortex to mix. This is Dilution B.
34. Take 111 uL of Dilution B and add to the last tube in the set. Vortex to mix. This is Dilution C. You should now have three dilutions of phage, where concentrations of each differ by a factor of 10.
35. Pour the contents of Dilution C (the most dilute of the 3 samples) into the solution basin and load the multichannel pipetman.
36. Dispense 20 uL per well into the first row of the 384-well plate (12 channels×2=24 wells).

37. Expel the remaining liquid in the tips by touching the tips against the surface of the basin and pressing the RESET button on the pipetman. Lay the pipetman down in a way to prevent contamination of the tips. There is no need to change the tips at this point.
38. Empty the basin as described above.
39. Pour the contents of Dilution B into the same basin and load the multichannel pipetman.
40. Dispense 20 uL per well into the second row of the 384-well plate.
41. Perform steps 13-16 similarly to dispense Dilution A into the third row of the plate.
42. After all three dilutions have been arrayed into the first 3 rows of the plate, discard all tips and the solution basin into the biohazardous waste container.
43. Mount the pipetman with a clean set of sterile tips and open a new sterile solution basin.
44. Repeat steps 8-19 for each remaining putative hit, using remaining rows on the plate up to row O. Five putative hits can be analyzed on one 384-well plate, with the last row (row P) saved for the controls.
45. Add 0.5 uL of each control to a separate well. Use at least 2-3 separate controls, preferably covering a range of activity.
46. Incubate assay plates at 37° C. overnight in a humidified ($\geq$95%) incubator.

Day 2

47. Pintool all breakout plates onto a host lawn with red starch using the same method described for Day 2 in *Lambda Microtiter Screening for glucoamylases*, except that a 384 position pintool is used.
48. Prepare the 2× BODIPY starch substrate buffer as follows:
    a) Calculate the total volume of 2× substrate buffer solution needed for all breakout plates at 20 uL per well (including any extra deadspace volume required by the dispenser used) and measure this amount of 100 mM CAPS pH 10.4 into a vessel appropriate for the dispenser used.
    b) Retrieve enough 0.5 mg tubes of BODIPY starch to produce the required volume of 2× substrate buffer [calculated in step a) above] at a final concentration of 20-30 ug/mL.
    c) Dissolve each 0.5 mg tube in 50 uL DMSO at room temperature, protected from light, with frequent vortexing. This takes more than 15 minutes; some production lots of BODIPY starch dissolve better than others.
    d) Add 50 uL 100 MM CAPS buffer pH 10.4 to each tube and mix by vortexing.
    e) Pool the contents of all tubes and remove any undissolved aggregates by centrifuging for 1 minute at maximum speed in a microfuge.
    f) Add the supernatant to the rest of the 100 mM CAPS buffer measured in step a) above.
    g) Protect the 2× substrate buffer from light by wrapping in foil.
49. Dispense 20 uL per well into all breakout plates.
50. Wrap all plates in aluminum foil and incubate at room temperature for 2-6 hours.
51. Read each plate in the Spectrafluor with the following settings:
    a) fluorescence read (excitation filter: 485 nm; emission filter: 535 nm)
    b) plate definition: 384 well black
    c) read from the top
    d) optimal gain
    e) number of flashes: 3
52. On the resulting Excel spreadsheet, chart each putative's 3 rows in a separate graph and check for activity. Ensure that the positives controls produced signals over background.
53. For each putative that appears to have a real signal among the wells, harvest a sample from a positive well as follows:
    a) Select a positive well from a row representing the highest initial dilution.
    b) Transfer 2 uL from that well into a tube containing 500 uL SM and 50 uL CHCl$_3$. This is referred to as the breakout stock.
    c) Store at 4° C.
54. Using methods previously described, plate about 10 uL of each breakout stock onto 150 mm NZY plates using red starch. The objective is to obtain several (at least 20) well-separated plaques from which to core isolates.

Day 3

55. Check pintooled plates for an acceptable incidence of clearings in the bacterial lawn corresponding to wells on the associated assay plate. Also check for clearings in the red starch in the positive controls and in any tested putatives. Be wary of contaminants that also form clearing zones in red starch (see below).
56. From the solid phase plates containing dilutions of breakout stocks, core several isolated plaques, each into 500 uL SM with 50 uL CHCl$_3$. This is referred to as the isolate stock.
57. The isolate stocks can then be individually tested on BODIPY starch using methods described above. This step can be skipped if the plaque that was cored in step 2 produced a clearing zone in the red starch background. The isolate stocks were then be individually tested on BODIPY starch using methods described above. However, this step may be skipped if the plaque that was cored in step 2 produced a clearing zone in the red starch background.

Excisions

Day 1

58. In a Falcon 2059 tube, mix 200 uL OD1 XL1-Blue MRF' host, 100 uL lambda isolate stock and 1 uL ExAssist phage stock.
59. Incubate in 37° C. shaker for 15 minutes.
60. Add 3 mL NZY medium.
61. Incubate in 30° C. shaker overnight.

Day 2

10. Heat to excision tube to 70° C. for 20 minutes.
11. Centrifuge 1000×g for 10 minutes.
12. In a Falcon 2059 tube, combine 50 uL supernatant with 200 uL EXP505 OD1 host.
13. Incubate in 37° C. shaker for 15 minutes.
14. Add 300 uL SOB medium.
15. Incubate in 37C shaker for 30-45 minutes.
16. Plate 50 uL on large LB$_{Kan50}$ plate using sterile glass beads. If the plates are "dry", extra SOB medium can be added to help disburse the cells.
17. Incubate plate at 30° C. for at least 24 hours.
18. Culture an isolate for sequencing and/or RFLP.

Growth at 30° C. reduces plasmid copy number and is used to mitigate the apparent toxicity of some glucoamylase clones.

Contaminants That Form Clearing Zones in Red Starch

When using red starch on solid medium to assay phage for glucoamylase activity, it is common to see contaminating colony forming units (cfu) that form clearing zones in the red starch. For pintooled plates, it is important to distinguish glucoamylase-positive phage clones from these contaminants whenever they align with a particular well position. The source of the contaminating microbes is presumably the 2% red starch stock solution, which cannot be sterilized by autoclaving or by filtering after preparation. It is thought that they are opportunistic organisms that survive by metabolizing the red starch. In order to reduce these contaminants, use sterile technique when making 2% red starch solutions and store the stocks either at 4° C. or on ice.

Assay Using RBB-starch

75 μl of RBB-starch substrate (1% RBB-insoluble corn starch in 50 mM NaAc buffer, pH=4.5) can be added into each well of a new 96-well plate (V-bottom). Five micro-liters of enzyme lysate can be transferred into each well with substrate using Biomek or Zymark. The plates can be sealed with aluminum sealing tape and shaken briefly on the shaker. The plates can be incubated at 90° C. for 30 minutes, followed by cooling at room temperature for about 5 to 10 minutes. One hundred micro-liters of 100% ethanol is added to each well, the plates sealed and shaken briefly on the shaker. The plates are then centrifuged 4000 rpm for 20 minutes using bench-top centrifuge. 100 μl of the supernatant is transferred into a new 96-well plate (flat bottom) by Biomek and read $OD_{595}$.

Assay Using FITC-Starch

Add 50 μl of substrate (0.01% FITC-starch in 100 mM NaAc buffer, pH=4.5) into each well of a new 384-well plate. Transfer 5 μl of enzyme lysate into each well with substrate and incubate the plate at room temperature overnight. The polarization change of the substrate, excitation 485 nm, emission 535 nm, is read for each well. 96 well plates can be used for all assays.

Example 20

Exemplary Protocol for Liquefying Starch and Measuring Results

The following example described and exemplary protocol for liquefying starch. Reaction Conditions: 100 mM $PO_4$ pH 6.5, 1% (w/w) liquefied starch DE 12 at 55° C. Both TLC and HPLC assays can be done to verify activity.

An exemplary protocol for the saccharification of liquefied starch at pH 6.5:

Adjust the pH of the liquefied starch to the pH at which the saccharification(s) will be performed. Liquefy starch in 100 mM sodium acetate buffer, pH 4.5 with 100 mM sodium phosphate salts added so that before saccharification, the pH could be adjusted to pH 6.5.

Weigh 5 gram samples of liquefied starch into tared bottles. Use 0.04% (w/w) Optidex L-400 or approximately 400 mL of 1-10 diluted stock Optidex L-400 per 100 grams of liquefied starch.

Calculate the milligrams of Optidex L-400 contained in the 400 mL of 1-10 diluted stock Optidex L-400. Next, calculate the volume of lysates needed to give the same concentration of enzyme as the Optidex L-400.

Add enzymes to liquefied starch samples and incubate at desired temperature (50° C.). After 18 hours determine DE and prepare a sample for HPLC analysis.

An Exemplary DE Determination:

Exemplary Neocuproine Assay:

A 100 ml sample can be added to 2.0 ml of neocuproine solution A (40 g/L sodium carbonate, 16 g/L glycine, 0.45 g/L copper sulfate). To this can be added 2.0 ml of neocuproine solution B (1.2 g/L neocuproine hydrochloride-Sigma N-1626). The tubes can be mixed and heated in a boiling water bath for 12 minutes; cooled, diluted to 10 ml volume with DI water and the OD read at 450 nm on the spectrophotometer. The glucose equivalent in the sample can be extrapolated from the response of a 0.2 mg/ml glucose standard run simultaneously.

Exemplary HPLC Analysis:

Saccharification carbohydrate profiles are measured by HPLC (Bio-Rad Aminex HPX-87A column in silver form, 80° C.) using refractive index detection. Mobile phase is filtered Millipore water used at a flow rate of 0.7 ml/min. Saccharification samples are diluted 1-10 with acidified DI water (5 drops of 6 M HCl into 200 mL DI water) then filtered through a 0.45 mm syringe filter. Injection volume is 20 uL.

Exemplary TLC:

Reaction products can be w/d at hourly timepoints and spotted and dried on a TLC plate. The plate can be then developed in 10:90 water:isopropanol and visualized with either a vanillin stain or CAM stain and then heated to show reducible sugars. The liquefied starch can be partially hydrolyzed to glucose in cases where activity was observed.

Example 21

Starch Liquefaction Using Glucoamylases

This example describes an exemplary method of the invention for liquefying starch using glucoamylases of the invention. Glucoamylase concentrate can be prepared from fermentation broths by heat treatment, cell washing, alkaline extraction using microfiltration and ultrafiltration (48% overall yield). The UF concentrate can be neutralized with acetic acid and formulated with 30% glycerol at pH 4.5. The activity level of a commercial product can be about 120 $U^1$/g -0.5 kg/ton starch.

Exemplary Glucoamylase Activity Essay

A 1 mL cuvette containing 950 μL of 50 mM MOPS pH 7.0 containing 5 mM PNP-α-D-hexa-(1→4)-glucopyranoside is placed in the Peltier temperature controller of the Beckman DU-7400 spectrophotometer preheated to 80° C. The spectrophotometer is blanked at 405 nm and 50 μL of the enzyme solution is added to the cuvette, mixed well and the increase in the $OD_{405nm}$ is monitored over a one-minute interval. The $\Delta OD_{405nm/min}$ rate is converted to a standard unit of μmole/minute from the $OD_{405nm}$ response of 50 μL of 1 μmole/mL PNP in 950 mL 50 mM MOPS at pH 7.0-80° C. One standard unit of thermostable alpha glucoamylase (DTAA) is equal to the amount of enzyme that will catalyze the release of 1 μmole/mL/minute of pNP under the defined conditions of the assay.

Standard Glucoamylase Activity Assay

A 1 mL cuvette containing 950 μL of 50 mM MOPS pH 7.0 containing 5 mM pNP-α-D-glucopyranoside is placed in the Peltier temperature controller of the Beckman DU-7400 spectrophotometer preheated to 60° C. The spectrophotometer is blanked at 405 nm and 50 μL of the enzyme solution is added to the cuvette, mixed well and the increase in the $OD_{405nm}$ is monitored over a one-minute interval. The $\Delta OD_{405\ nm/min}$ rate is converted to a standard unit of μmole/minute from the $OD_{405\ nm}$ response of 50 μL of 1 μmole/mL pNP in 950 mL 50 mM MOPS at pH 7.0-60° C. One standard Diversa unit of glucoamylase (DGA) is equal to the amount of enzyme that will catalyze the release of 1 μmole/mL/minute of pNP under the defined conditions of the assay.

Dextrose Equivalent Determination

The neocuproine method is used to measure the DE. Selected samples were measured by both the Invention procedure and by a GPC analyst using the GPC Fehlings procedure.

Neocuproine Assay

A 100 μl sample is added to 2.0 ml of neocuproine solution A (40 g/L sodium carbonate, 16 g/L glycine, 0.45 g/L copper sulfate). To this is added 2.0 ml of neocuproine solution B (1.2 g/L neocuproine hydrochloride-Sigma N-1626). The tubes were mixed and heated in a boiling water bath for 12 minutes; cooled, diluted to 10 ml volume with DI water and the OD read at 450 nm on the spectrophotometer. The glucose equivalent in the sample is extrapolated from the response of a 0.2 mg/ml glucose standard run simultaneously.

The starch sample is diluted ~1 to 16 with DI water with the exact dilution recorded. Ten milliliters of the diluted sample is added to 20 mls of DI water. Ten milliliters of Fehlings solution A and B were added to the diluted starch. The sample is boiled for 3 minutes and cooled on ice. Ten milliliters of 30% KI and 10 ml of 6N $H_2SO_4$ is added. The solution is titrated against 0.1N sodium thiosulfate. The titrant volume is recorded and used to calculate the DE.

Residual Starch Determination

Post-saccharification samples were checked for residual starch using the Staley iodine procedure.

Twenty grams of sample is weighed into a large weigh dish. 45 μL of Iodine solution is added to the weigh dish and the starch solution is mixed well. Dark blue indicates the presence of starch, a light blue-green indicates slight starch, light green indicates a trace of starch and yellow-red, absence of starch. Iodine solution is prepared by dissolving 21.25 grams of iodine and 40.0 grams of potassium iodide in one liter of water.

Oligosaccharide Profile

Liquefaction and saccharification carbohydrate profiles were measured by HPLC (Bio-Rad Aminex HPX-87C column in calcium form –80° C.) using refractive index detection.

Gel Permeation Chromatography

The molecular weight distribution is determined by chromatography on a PL Aquagel-OH column with mass detection by refractive index (Waters Model 2410). A Viscotek Model T60 detector is used for continuous viscosity and light scattering measurements.

Capillary Electrophoresis

Beckman Coulter P/ACE MDQ Glycoprotein System—separation of APTS derivatized oligosaccharides on a fused silica capillary—detection by laser-induced fluorescence.

Primary Liquefaction

Line starch directly from the GPC process is pumped into a 60 liter feed tank where pH, DS (dry solids) and calcium level can be adjusted before liquefaction. The glucoamylase is added to the slurry. The 32% DS slurry is pumped at 0.7 liter/minute by a positive displacement pump to the jet—a pressurized mixing chamber where the starch slurry is instantaneously heated to greater than 100° C. by steam injection. The gelatinized partially liquefied starch is pumped through a network of piping (still under pressure) to give the desired dwell time (5 minutes) at temperature. The pressure is released into a flash tank and samples can be taken. Samples were taken in duplicate.

Secondary Liquefaction

The liquefied starch is collected in one liter glass bottles and held in a water bath at 95° C. for 90 minutes.

Saccharification

Liquefied starch is cooled to 60° C., the pH adjusted to 4.5 and the samples treated with glucoamylase. Saccharification progress is monitored over time by HPLC.

Saccharification

The liquefied syrups produced with each glucoamylase were adjusted to approximately pH 2.5 with 6N HCl immediately after the 90 minute secondary liquefaction to inactivate any residual glucoamylase. The syrups were then adjusted to pH 4.5, placed in a 60° C. water bath and saccharified with three levels of glucoamylase. The extent of saccharification is monitored by HPLC at 18 to 88 hour time points.

The liquefied syrups were saccharified with the standard dosage—0.04% of a double-strength glucoamylase—and two lower dosages (50% and 25%) to monitor any differences in the saccharification progress.

Saccharification Progress—% dextrose development vs time—0.04% glucoamylase.

Example 22

Starch Liquefaction at pH 4.5 Using Glucoamylases

The conversion of starch to glucose can be catalyzed by the sequence action of two enzymes: amylases (e.g., alpha-amylases), including enzymes of the invention, to liquefy the starch (e.g., the hydrolysis of high molecular weight glucose polymers to oligosaccharides consisting of 2 to 20 glycose units, typically a dextrose equivalent of 10 to 12, by a glucoamylase of the invention), followed by saccharification with a glucoamylase (which can be a glucoamylase of the invention, e.g., SEQ ID NO:594). In one aspect, processing is in a corn wet milling plant producing a starch slurry having a pH or about 4.0 to 4.5. In one aspect, the pH is raised, e.g., to 5.8 to 6.0 before liquefaction to accommodate a glucoamylase with a low pH activity and stability. In one aspect, glucoamylases of the invention can liquefy starch at pH 4.5 to dextrose equivalents ranging from 12 to 18; in one aspect, using glucoamylases of the invention at levels of about 3 to 6 grams per ton of starch. In this aspect, use of glucoamylases of the invention enables starch liquefaction to be conducted at pH 4.5.

In one aspect, starch liquefaction is conducted at pH 4.5 for 5 minutes at 105° C. to 90 minutes at 95° C. using glucoamylases of the invention. The quantity of enzyme is adjusted in order to adjust a target DE of 12 to 15 after liquefaction. In one aspect, the liquefied starch is then saccharified with a glucoamylase, e.g., an *Aspergillis* glucoamylase, for about 48 hours at about pH 4.5 and 60° C. If the saccharified syrup did not contain at least 95% glucose, the target liquefaction DE is raised and the saccharification repeated until the liquefaction eventually did produce a saccharified syrup containing more than 95% glucose. The glucoamylase protein required to produce a suitable liquefied feedstock for saccharification is determined by PAGE.

A number of embodiments of the invention have been described. Nevertheless, it will be understood that various modifications may be made without departing from the spirit and scope of the invention. Accordingly, other embodiments are within the scope of the following claims.

SEQUENCE LISTING (622 sequences)

SEQ ID NO: 1 - DNA, 1311 bp, Artificial Sequence
  Synthetically generated oligonucleotide
atggcaaagtattccgagctcgaagagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 2 - protein, 436 aa, Artificial Sequence
  Synthetically generated peptide
MAKYSELEEGGLIMQAFYWDVPMGGIWWDTIAQKIPDWASAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYGAWVVKDWLDWWGGWAVGEYWDTNVDALLNWAYSSDAKVFDFPLYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 3 - DNA, 1311 bp, Artificial Sequence
  Synthetically generated oligonucleotide
atggccaagtacctggagctcgaagagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaattacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcgaagccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctattgcggtgttgggtga

SEQ ID NO: 4 - protein, 436 aa, Artificial Sequence
  Synthetically generated peptide
MAKYLELEEGGLIMQAFYWDVPMGGIWWDTIAQKIPDWASAGISAIWIPPASKGMGGAYSMGYDPYDFFDLGEYDQKGTVETRFGSKQELVNMINTAHAYGIKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSEAGRWVYVPKFAGACIHEYTGNLGGWVDKWVDSSGWVYLEAPAHDPANGYYGYSVWSYCGVG

SEQ ID NO: 5 - DNA, 1311 bp, Artificial Sequence
  Synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcccccggcaagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgctttcatcctcacctacgaaggccagcccgtcatattctaccgcgaccacgaggagtggctcaacaaggacaggttgaacaacctcatatggatacacgaccacctcgcaggtggaagcaccgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggggtgggctga

SEQ ID NO: 6 - protein, 436 aa, Artificial Sequence
  Synthetically generated peptide
MAKYSELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYLAYAFILTYEGQPVIFYRDHEEWLNKDRLNNLIWIHDHLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 7 - protein, 16 aa, Unknown
  Obtained from an environmental sample.
MALEEGGLIMQAFYWD

SEQ ID NO: 8 - protein, 26 aa, Bacterial
MKPAKLLVFVLVVSILAGLYAQPAGA

SEQ ID NO: 9 - DNA, 1311 bp, Artificial Sequence
  Synthetically generated oligonucleotide
atggccaagtactccgagctggaagagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgcgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 10 - protein, 436 aa, Artificial Sequence
  Synthetically generated peptide
MAKYSELEEGGLIMQAFYWDVPMGGIWWDTIAQKIPDWASAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTDIVYYDNDELIFARNGYGSKPGLITYINLASSKAGRWVYVPKFAGSCIHEYTGNLGGWVDKWVDSSGWVYLEAPAHDPANGQYGYSVWSYCGVG

SEQ ID NO: 11 - DNA, 1311 bp, Artificial Sequence
  Synthetically generated oligonucleotide
atggccaagtacctggagctcgaggagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggatacgctcaagaacctcatctggatacatgacaacctcgccggaggaagcacgagcatagtttactacgacagcgacgagatgatcttcgtgaggaacggctatggaagcaagcctggccttataacttacatcaacctcggctcgagcaaggttggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggtgttggctga

SEQ ID NO: 12 - protein, 436 aa, Artificial Sequence
  Synthetically generated peptide
MAKYLELEEGGLIMQAFYWDVPMGGIWWDTIAQKIPDWASAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDTLKNLIWIHDNLAGGSTSIVYYDSDEMIFVRNGYGSKPGLITYINLGSSKVGRWVYVPKFAGACIHEYTGNLGGWVDKWVDSSGWVYLEAPAHDPANGYYGYSVWSYCGVG

SEQ ID NO: 13 - DNA, 1311 bp, Artificial Sequence
  Synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtatgaccagaagggaacggtagagacgcgctttggctccaagcaggagctcgtgaacatgataaacacggcacatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggtgttggctga

SEQ ID NO: 14 - protein, 436 aa, Artificial Sequence
  Synthetically generated peptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 15 - DNA, 1311 bp, Artificial Sequence
  Synthetically generated oligonucleotide
atggccaagtactccgagctggaagagggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatttggaacaagtacccggcctacgccttcatcctcacctacgagggccagccgacgatattctaccgcgactacgaggagtggctcaacaaggacaggctcaagaacctcatctggatacacgaccaccttgccggtggaagcactgacatcgtttactacgacaacgacgagctgatattcgtgagaaacggctacggaagcaagccgggactgataacatacatcaacctcgcctcaagcaaagccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttgggtga

SEQ ID NO: 16 - protein, 436 aa, Artificial Sequence
  Synthetically generated peptide
MAKYSELEEGGLIMQAFYWDVPMGGIWWDTIAQKIPDWASAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDRLKNLIWIHDHLAGGSTDIVYYDNDELIFVRNGYGSKPGLITYINLASSKAGRWVYVPKFAGACIHEYTGNLGGWVDKYVYSSGWVYLEAPAYDPANGQYGYSVWSYCGVG

SEQ ID NO: 17 - DNA, 1311 bp, Artificial Sequence
  Synthetically generated oligonucleotide
atggccaagtactccgagctggaagggggcgggctcataatgcaggccttctactgggacgtccccatgggaggaatctggtgggacacgatagcccagaagatacccgactgggcaagcgccgggatttcggcgatatggattcccccggcgagcaagggcatgggcggcgcctattcgatgggctacgacccctacgacttctttgacctcggtgagtacgaccaggagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 18 - protein, 436 aa, Artificial Sequence
  Synthetically generated peptide
MAKYSELEGGGLIMQAFYWDVPMGGIWWDTIAQKIPDWASAGISAIWIPPASKGMGGAYSMGYDPYDFFDLGEYDQEGTVETRFGSKQELVNMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTSIVYYDSDEMIFVRNGYGSKPGLITYINLGSSKVGRWVYVPKFAGSCIHEYTGNLGGWVDKWVDSSGWVYLEAPAHDPANGQYGYSVWSYCGVG

SEQ ID NO: 19 - DNA, 1311 bp, Artificial Sequence
  Synthetically generated oligonucleotide
atggccaagtacctggagctcgaagagggcgggctcataatgcaggccttctactgggacgtccccatgggaggaatctggtgggacacgatagcccagaagatacccgactgggcaagcgccgggatttcggcgatatggattcctcccgcgagcaagggtatgagcggcggctattcgatgggctacgacccctacgattattttgaccttggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtgggggggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatttggaacaagtacccggcctacgccttcatcctcacctacgagggccagccgacgatattctaccgcgactacgaggagtggctcaacaaggacaggctcaagaacctcatctggatacacgaccacctcgccggtggaagcactgacatcgtttactacgacaacgacgagctgatattcgtgagaaacggctacggaagcaagccgggactgataacatacatcaacctcgcctcaagcaaagccggaaggtgggtttatgtgccgaagttcgcgggcgcgtgcatccacgagcatactggtaacctcggaggctgggtagacaagtacgtctactcaagcggctgggtctatctcgaagctccagcttacgaccctgccaacgggcagtatggctactccgtgtggagctactgcggtgttggctga

SEQ ID NO: 20 - protein, 436 aa, Artificial Sequence
  Synthetically generated peptide
MAKYLELEEGGLIMQAFYWDVPMGGIWWDTIAQKIPDWASAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYPAYAFILTYEGQPTIFYRDYEEWLNKDRLKNLIWIHDHLAGGSTDIVYYDNDELIFVRNGYGSKPGLITYINLASSKAGRWVYVPKFAGACIHEHTGNLGGWVDKYVYSSGWVYLEAPAYDPANGQYGYSVWSYCGVG

SEQ ID NO: 21 - DNA, 1311 bp, Artificial Sequence
  Synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcctcccgggagcaagggtatgagcggcggctattcgatgggctacgacccctacgatgatttggacctgggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggtatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatttggaacaagtacccggcctacgccttcatcctcacctacgagggccagccgacgatattctaccgcgactacgaggagtggctcaacaaggacaggctcaagaacctcatctggatacacgactacctcgccggtggaagcactgacatcgtttactacgacaacgacgagctgatattcgtgagaaacggctacggaagcaagccgggactgataacatacatcaacctcgcctcaagcaaagccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttggctga

SEQ ID NO: 22 - protein, 436 aa, Artificial Sequence
  Synthetically generated peptide
MAKYSELEEGGVIMQAFYWDVPGGGIWWDTIRSKIPEWYEAGISAIWIPPGSKGMSGGYSMGYDPYDDLDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAVYLRSIGIDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDRLKNLIWIHDYLAGGSTDIVYYDNDELIFVRNGYGSKPGLITYINLASSKAGRWVYVPKFAGACIHEYTGNLGGWVDKYVYSSGWVYLEAPAYDPANGQYGYSVWSYCGVG

SEQ ID NO: 23 - DNA, 1311 bp, Artificial Sequence
  Synthetically generated oligonucleotide
atggccaagtactccgagctggaagagggcggcgttatagtgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcatgagcatagtttactacgacagcgacgagatgatcttcgtgaggaacggctatggaagcaagcctggccttataacttacatcaacctcggctcgagcaaggttggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctattgcggtgttggctga

SEQ ID NO: 24 - protein, 436 aa, Artificial Sequence
  Synthetically generated peptide
MAKYSELEEGGVIVQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSMSIVYYDSDEMIFVRNGYGSKPGLITYINLGSSKVGRWVYVPKFAGACIHEYTGNLGGWVDKWVDSSGWVYLEAPAHDPANGYYGYSVWSYCGVG

SEQ ID NO: 25 - DNA, 1311 bp, Artificial Sequence
  Synthetically generated oligonucleotide
atggccaagtacctggagctcgaagagggcgggctcataatgcaggccttctactgggacgtccccatgggaggaatctggtgggacacgatagcccagaagatacccgactgggcaagcgccgggatttcggcgatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtgggcgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggcacggctacggggacaagccggggcttataacctacatcaacctaggctcgagcaaggccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctattgcggtgttgggtga

SEQ ID NO: 26 - protein, 436 aa, Artificial Sequence
  Synthetically generated peptide
MAKYLELEEGGLIMQAFYWDVPMGGIWWDTIAQKIPDWASAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVGALRYGQTVVSRDPFKAVTFVANHDTDIIWNKYPAYAFILTYEGQPTIFYRDYEEWLNKDKLKNLIWIHDNLAGGSTDIVYYDNDELIFVRHGYGDKPGLITYINLGSSKAGRWVYVPKFAGSCIHEYTGNLGGWVDKWVDSSGWVYLEAPAHDPANGQYGYSVWSYCGVG

SEQ ID NO: 27 - DNA, 1311 bp, Artificial Sequence
  Synthetically generated oligonucleotide
atggcaaagtattccgagctcgaagagggcggcgttataatgcaggccttctactgggacgtcccaggtggaggaatctggtgggacaccatcaggagcaagataccggagtggtacgaggcgggaatatccgccatttggattcctcccgcgagcaagggtatgagcggcggctattcgatgggctacgacccctacgattattttgacctcggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcgtcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 28 - protein, 436 aa, Artificial Sequence
  Synthetically generated peptide
MAKYSELEEGGVIMQAFYWDVPGGGIWWDTIRSKIPEWYEAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 29 - DNA, 1311 bp, Artificial Sequence
  Synthetically generated oligonucleotide
atggccaagtacctggagctcgaagagggcgggctcataatgcaggccttctactgggacgtccccatgggaggaatctggtgggacacggtagcccagaagatacccgactgggcaagcgccgggatttcggcgatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggtctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgccttcatcctcacctacgaaggccagcccgtcatattctaccgcgactacgaggagtggctcaacaaggacaggttgaacaacctcatatggatacacgaccacctcgcagggggaagcaccgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggtgttgggtga

SEQ ID NO: 30 - protein, 436 aa, Artificial Sequence
  Synthetically generated peptide
MAKYLELEEGGLIMQAFYWDVPMGGIWWDTVAQKIPDWASAGISAIWIPPASKGMGGAYSMGYDPYDFFDLGEYDQKGTVETRFGSKQELVNMINTAHAYGIKVIADIVINHRAGGDLEWNPFVGDYTWTDFSKVVSGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 31 - DNA, 1311 bp, Artificial Sequence
  Synthetically generated oligonucleotide
atggcaaagtactccgagctggaagagggcggcgttataatgcaggccttctactgggacgtcccaggtggaggaatctggtgggacaccatcaggagcaggataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctggccggaggaagcacgagcatagtttactacgacagcgacgagatgatcttcgtgaggaccggctatggaagcaagcctggccttataacttacatcaacctcggctcgagcaaggttggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttggctga

SEQ ID NO: 32 - protein, 436 aa, Artificial Sequence
  Synthetically generated peptide
MAKYSELEEGGVIMQAFYWDVPGGGIWWDTIRSRIPEWYEAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDTNVDALLNWAYSSGAKVFDFPLYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTSIVYYDSDEMIFVRTGYGSKPGLITYINLGSSKVGRWVYVPKFAGACIHEYTGNLGGWVDKYVYSSGWVYLEAPAYDPANGQYGYSVWSYCGVG

SEQ ID NO: 33 - DNA, 1311 bp, Artificial Sequence
  Synthetically generated oligonucleotide
atggccaagtactccgagctggaagagggcggggtcataatgcaggcgttctactgggacgtgccttcaggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgactttccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaccaagtaccttgcttatgctttcatcctcacctacgaaggccagcccgtcatattctaccgcgactacgaggagtggctcaacaaggacaggttgaacaacctcatatggatacacgaccacctcgcaggtggaagcaccgacatagtctactacgataacgatgaactcatcttcgtcaggaacggctacggggacaagccggggcttataacctacatcaacctaggctcgagcaaggccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttggctga

SEQ ID NO: 34 - protein, 436 aa, Artificial Sequence
  Synthetically generated peptide
MAKYSELEEGGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDTNVDALLNWAYSSGAKVFDFPLYYKMDAAFDNKNIPALVEALKNGGTVVSRDPFKAVTFVANHDTDIIWTKYLAYAFILTYEGQPVIFYRDYEEWLNKDRLNNLIWIHDHLAGGSTDIVYYDNDELIFVRNGYGDKPGLITYINLGSSKAGRWVYVPKFAGSCIHEYTGNLGGWVDKWVDSSGWVYLEAPAHDPANGQYGYSVWSYCGVG

SEQ ID NO: 35 - DNA, 1311 bp, Artificial Sequence
  Synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacgtcgccggaggaagcaccgacatagtctactacgataacgatgaactcatcttcgtcaggaacggctacggggacaagccggggcttataacctacatcaacctaggctcgagcaaggccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 36 - protein, 436 aa, Artificial Sequence
  Synthetically generated peptide
MAKYSELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRAGGDLEWNPFVNDYTWTDFSKVASGKYTANYLDFHPNEVKCCDEGTFGGFPDIAHEKSWDQHWLWASDESYAAYLRSIGVDAWRFDYVKGYAPWVVKDWLNWWGGWAVGEYWDTNVDAVLNWAYSSGAKVFDFALYYKMDAAFDNKNIPALVEALKNGGTVVSRDPFKAVTFVANHDTDIIWNKYPAYAFILTYEGQPTIFYRDYEEWLNKDKLKNLIWIHDNVAGGSTDIVYYDNDELIFVRNGYGDKPGLITYINLGSSKAGRWVYVPKFAGSCIHEYTGNLGGWVDKWVDSSGWVYLEAPAHDPANGQYGYSVWSYCGVG

SEQ ID NO: 37 - DNA, 1311 bp, Artificial Sequence
  Synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgcgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctatcgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggggtggggtga

SEQ ID NO: 38 - protein, 436 aa, Artificial Sequence
  Synthetically generated peptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYGARVVKDWLNWWGGWAVGEYWDTNVDALLNWAYSSGAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 39 - DNA, 1311 bp, Artificial Sequence
  Synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcctcccgcgagcaggggtatgagcggcggctattcgatgggctacgacccctacgattattttgacctcggtgagtactaccagaagggaacggtggaaacgaggttcggctcaaagcaggagctcataaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggtatcgatgcctggcgctttgactacgtgaagggctacggagcgtgggtcgtcaaggactggctcaactggtggggcggctgggccgttggcgagtactgggaccccaacgttgatgccctcctcccctgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggaacggctacggggacaagccggggcttataacctacatcaacctaggctcgagcaaggccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggggtgggctga

SEQ ID NO: 40 - protein, 436 aa, Artificial Sequence
  Synthetically generated peptide
MAKYLELEEGGVIMQAFYWDVPSGGIWWDTIRQKIPEWYDAGISAIWIPPASRGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDPNVDALLPWAYSSGAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGSSKAGRWVYVPKFAGACIHEYTGNLGGWVDKWVDSSGWVYLEAPAHDPANGYYGYSVWSYCGVG

SEQ ID NO: 41 - DNA, 1311 bp, Artificial Sequence
  Synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcacgagcatagtttactacgacagcgacgagatgatcttcgtgaggaacggctatggaagcaagcctggccttataacttacatcaacctcggctcgagcaaggttggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggtgttgggtga

SEQ ID NO: 42 - protein, 436 aa, Artificial Sequence
  Synthetically generated peptide
MAKYLELEEGGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDTNVDALLNWAYSSGAKVFDFPLYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTSIVYYDSDEMIFVRNGYGSKPGLITYINLGSSKVGRWVYVPKFAGACIHEYTGNLGGWVDKYVYSSGWVYLEAPAYDPANGQYGYSVWSYCGVG

SEQ ID NO: 43 - DNA, 1311 bp, Artificial Sequence
  Synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgtcggaggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttggctga

SEQ ID NO: 44 - protein, 436 aa, Artificial Sequence
  Synthetically generated peptide
MAKYSELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLVGGSTSIVYYDSDEMIFVRNGYGSKPGLITYINLGSSKVGRWVYVPKFAGSCIHEYTGNLGGWVDKWVDSSGWVYLEAPAHDPANGQYGYSVWSYCGVG

SEQ ID NO: 45 - DNA, 1311 bp, Artificial Sequence
  Synthetically generated oligonucleotide
atggccaagtactccgacctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttgggtga

SEQ ID NO: 46 - protein, 436 aa, Artificial Sequence
  Synthetically generated peptide
MAKYSDLEEGGVIMQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 47 - DNA, 1311 bp, Artificial Sequence
  Synthetically generated oligonucleotide
atggccaagtacaccgagctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggttgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgctttcatcctcacctacgaaggccagcccgtcatattctaccgcgactacgaggagtggctcaacaaggacaggttgaacaacctcatatggatacacgaccacctcgcaggtggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggcccgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtag

SEQ ID NO: 48 - protein, 436 aa, Artificial Sequence
  Synthetically generated peptide
MAKYTELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTSIVYYDSDEMIFVRNGYGSKPGLITYINLGSSKVGRWVYVPKFAGPCIHEYTGNLGGWVDKWVDSSGWVYLEAPAHDPANGQYGYSVWSYCGVG

SEQ ID NO: 49 - DNA, 387 bp, Artificial Sequence
  Synthetically generated oligonucleotide
gtggtttatgacgatgtccgctatgacctttatgccgtaggcatgggccgtgtttatcatgttcacgagctcctgcttggagccaaagcgcgtctctaccgttcccttctggtcgtactcaccgaggtcaaagaagtcgtaggggtcgtagcccatcgaataggcgccgcccatgcccttgctcgccgggggaatccatatcgccgaaatcccggcgcttgcccagtcgggtatcttctgggctatcgtgtcccaccagattcctcccatggggacgtcccagtagaaggcctgcattatgagcccgccctcttcgagcccggaatactttgccataagttacctcctactagtagattaaaattctgtttcctgtgtgaaattgtt

SEQ ID NO: 50 - protein, 129 aa, Artificial Sequence
  Synthetically generated peptide
VVYDDVRYDLYAVGMGRVYHVHELLLGAKARLYRSLLVVLTEVKEVVGVVAHRIGAAHALARRGNPYRRNPGACPVGYLLGYRVPPDSSHGDVPVEGLHYEPALFEPGILCHKLPPTSRLKFCFLCEIV

SEQ ID NO: 51 - DNA, 1311 bp, Artificial Sequence
  Synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctattgcggtgttggctga

SEQ ID NO: 52 - protein, 436 aa, Artificial Sequence
  Synthetically generated peptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 53 - DNA, 1311 bp, Artificial Sequence
  Synthetically generated oligonucleotide
atggccaagtactccgagctggaagagggcggcgttataatgcaggccttctactgggacgtcccaggtggaggaatctggtgggacaccatcaggagcaagataccggagtggtacgaggcgggaatatccgccatttggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcacaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggtgttggctga

SEQ ID NO: 54 - protein, 436 aa, Artificial Sequence
  Synthetically generated peptide
MAKYSELEEGGVIMQAFYWDVPGGGIWWDTIRSKIPEWYEAGISAIWIPPASKGMGGAYSMGYDPYDFFDLGEYDQKGTVETRFGSKQELVNMINTAHAYGIKVIADIVINHRTGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGACIHEYTGNLGGWVDKWVDSSGWVYLEAPAHDPANGYYGYSVWSYCGVG

SEQ ID NO: 55 - DNA, 1311 bp, Artificial Sequence
  Synthetically generated oligonucleotide
atggccaagtacctggagctcgaggagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgctttcatcctcacctacgaaggccagcccgtcatattctaccgcgactacgaggagtggctcaacaaggacaggttgaacaacctcatatggatacacgaccacctcgcaggtggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctattgcggtgttggctga

SEQ ID NO: 56 - protein, 436 aa, Artificial Sequence
  Synthetically generated peptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTSIVYYDSDEMIFVRNGYGSKPGLITYINLGSSKVGRWVYVPKFAGSCIHEYTGNLGGWVDKWVDSSGWVYLEAPAHDPANGQYGYSVWSYCGVG

SEQ ID NO: 57 - DNA, 1311 bp, Artificial Sequence
  Synthetically generated oligonucleotide
atggccaagtacctggagctcgaagagagcggggtcataatgcaggcgttctactgggacgtgccttcaggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggtggctgggccgtcggggagtactgggacacaaacgttgatgcactgctcaactgggcctactcgagcgatgcaaaagtcttcgacttcccgctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtaccttgcttatgctttcatcctcacctacgaaggccagcccgtcatattctaccgcgactacgaggagtggctcaacaaggacaggttgaacaacctcatatggatacacgaccacctcgcaggtggaagcactgacatcgtttactacgacaacgacgagctgatattcgtgagaaacggctacggaagcaagccgggactgataacatacatcaacctcgcctcaagcaaagccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctattgcggtgttggctga

SEQ ID NO: 58 - protein, 436 aa, Artificial Sequence
  Synthetically generated peptide
MAKYLELEESGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVNDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSDAKVFDFPLYYKMDEAFDNNNIPALVDALRYGQTVVSRDPFKAVTFVANHDTDIIWNKYLAYAFILTYEGQPVIFYRDYEEWLNKDRLNNLIWIHDHLAGGSTDIVYYDNDELIFVRNGYGSKPGLITYINLASSKAGRWVYVPKFAGACIHEYTGNLGGWVDKWVDSSGWVYLEAPAHDPANGYYGYSVWSYCGVG

SEQ ID NO: 59 - DNA, 1311 bp, Artificial Sequence
  Synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgatataatttggaacaagtacccggcctacgccttcatcctcacctacgagggccagccgacgatattctaccgcgactacgaggagtggctcaacaaggacaggctcaagaacctcatctggatacacgaccacctcgccggtggaagcactgacatcgtttactacgacaacgacgagctgatattcgtgagaaacggctacggaagcaagccgggactgataacatacatcaacctcgcgtcaagcaaagccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttgggtga

SEQ ID NO: 60 - protein, 436 aa, Artificial Sequence
  Synthetically generated peptide
MAKYLELEEGGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDRLKNLIWIHDHLAGGSTDIVYYDNDELIFVRNGYGSKPGLITYINLASSKAGRWVYVPKFAGACIHEYTGNLGGWVDKYVYSSGWVYLEAPAYDPANGQYGYSVWSYCGVG

SEQ ID NO: 61 - DNA, 1311 bp, Artificial Sequence
  Synthetically generated oligonucleotide
atggccaagtactccgagctgaaaaagggcggggtcataatgcaggcgttctactgggacgtgccttcaggaggaatatggtgggacacaatacggcagaagataccggagtggtacgaggcgggaatatccgccatttggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcaacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccatgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggaacggctacggggacaagccggggcttataacctacatcaacctaggctcgagcaaggccggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggggtgggctga

SEQ ID NO: 62 - protein, 436 aa, Artificial Sequence
  Synthetically generated peptide
MAKYSELKKGGVIMQAFYWDVPSGGIWWDTIRQKIPEWYEAGISAIWIPPASKGMSGGYSMGYDPYDYFDLGEYYQKGTVETRFGSKQELINMINTAHAYGIKVIADIVINHRAGGDLEWNPFVNDYTWTDFSKVASGKYTANYLNFHPNELHAGDSGTFGGYPDICHDKSWDQYWLWASQESYAAYLRSIGIDAWRFDYVKGYGAWVVKDWLDWWGGWAVGEYWDTNVDALLNWAYSSDAKVFDFPLYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGSSKAGRWVYVPKFAGACIHEYTGNLGGWVDKWVDSSGWVYLEAPAHDPANGYYGYSVWSYCGVG

SEQ ID NO: 63 - DNA, 1311 bp, Artificial Sequence
  Synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggccatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcaccgacatagtctactacgataacgatgaactcatcttcgtcaggaacggctacggggacaagccggggcttataacctacatcaacctaggctggagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggggtggggtga

SEQ ID NO: 64 - protein, 436 aa, Artificial Sequence
  Synthetically generated peptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKAIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDAAFDNKNIPALVEALKNGGTVVSRDPFKAVTFVANHDTDIIWNKYPAYAFILTYEGQPTIFYRDYEEWLNKDKLKNLIWIHDNLAGGSTDIVYYDNDELIFVRNGYGDKPGLITYINLGWSKAGRWVYVPKFAGACIHEYTGNLGGWVDKYVYSSGWVYLEAPAYDPANGQYGYSVWSYCGVG

SEQ ID NO: 65 - DNA, 1311 bp, Artificial Sequence
  Synthetically generated oligonucleotide
atggccaagtactccgagctggaagaaggcggcgttataatgcaggccttctactgggacgtcccaggtggaggaatctggtggggcaccatcaggagcaagataccggagtggtacgaggcgggaatatccgccatttggattcctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgatataatttggaacaagtacccggcctacgccttcatcctcacctacgagggccagccgacgatattctaccgcgactacgaggagtggctcaacaaggacaggctcaagaacctcatctggatacacgaccacctcgccggtggaagcacgagcatagtttactacgacagcgacgagatgatcttcgtgaggaacggctatggaagcaagcctggccttataacttacatcaacctcggctcgagcaaggttggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctattgcggtgttggctga

SEQ ID NO: 66 - protein, 436 aa, Artificial Sequence
  Synthetically generated peptide
MAKYSELEEGGVIMQAFYWDVPGGGIWWGTIRSKIPEWYEAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDRLKNLIWIHDHLAGGSTSIVYYDSDEMIFVRNGYGSKPGLITYINLGSSKVGRWVYVPKFAGSCIHEYTGNLGGWVDKWVDSSGWVYLEAPAHDPANGQYGYSVWSYCGVG

SEQ ID NO: 67 - DNA, 1311 bp, Artificial Sequence
  Synthetically generated oligonucleotide
atggccaagtacctggagctcgaagagggcggggtcataatgcaggcgttctactgggacgtgccttcgggaggaatatggtgggacacaatacggcagaagataccggagtggtacgatgccggaatctccgcaatatggattcctcccgcgagcaagggtatgagcggcggctattcgatgggctacgacccctacgattattttgacctcggtgagtactaccagaagggaacggtggaaacgaggttcggctcaaagcaggagctcataaacatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggacgaggccttcgataacaacaacattcccgccctggtggacgccctcagatacggtcagacagtggtcagccgcgacccgttcaaggctgtgacgtttgtagccaaccacgataccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcacgagcatagtttactacgacagcgacgagatgatcttcgtgaggaacggctatggaagcaagcctggccttataacttacatcaacctcggctcgagcaaggttggaaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcgtggtgggctga

SEQ ID NO: 68 - protein, 436 aa, Artificial Sequence
  Synthetically generated peptide
MAKYLELEEGGVIMQAFYWDVPSGGIWWDTIRQKIPEWYDAGISAIWIPPASKGMSGGYSMGYDPYDYFDLGEYYQKGTVETRFGSKQELINMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLDWWGGWAVGEYWDTNVDALLNWAYSSDAKVFDFPLYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTSIVYYDSDEMIFVRNGYGSKPGLITYINLGSSKVGRWVYVPKFAGACIHEYTGNLGGWVDKWVDSSGWVYLEAPAHDPANGYYGYSVWSYCVVG

SEQ ID NO: 69 - DNA, 1542 bp, Unknown
  Obtained from an environmental sample.
atgttgaaaaggattacggtagtctgtttattgtttattttgctttttcctaatatatatgagggaaataaggcagaagcagcaacagtgaacaatggaacattaatgcagtattttgagtggtacgctccgaatgatgggaatcattggaatcgtttgcgttccgatgctgaaagtttagctcataaaggaatcacatctgtatggataccacctgcatataaagggacttcgcaaaatgatgtagggtatggggcctatgatttatatgatttaggggagttcaatcaaaaaggaacggtgcggacgaaatatgggacaaaagcacagttgaaatctgcaattgacgctttacataagcaaaacatcgacgtatacggtgatgtagttatgaatcataaaggtggggctgattatactgaaaccgtaacagctgttgaggtagaccgtaacaatcgaaatattgaagtatcaggtgattatcaaattagtgcatggacggggtttaattttccagggcgcggagatgcttattctaatttcaaatggaaatggtatcattttgacggaacggattgggatgaaggaaggaaattaaatcgaatttataaatttaggggtgtagataaagcgtgggattgggaagtgtctagcgaaaatggaaattatgattatttgatgtatgcagatcttgattttgatcatcctgatgttgcgaatgagatgaaaaattggggaacatggtatgcgaatgaattaaatttagatggctttcgtttggacgctgttaaacatattgatcatgaatatttacgcgattgggtaaatcatgccagacagcaaacggggaaagaaatgtttacagtagctgaatattggcaaaatgatgttcaggctttaaacaattatttagcgaaagtcaattataatcaatctgtgtttgatgcaccgcttcattacaattttcattatgcttcaacaggaaatgggaattatgatatgagaaatattttaaatggaacagtaatgaaaaatcaccctgcactcgcagttactctcgttgagaatcatgattctcagcctgggcagtcattggaatctgtagtaagtccgtggtttaagccgctggcatatgcatttattttaactcgtgcagagggctatccttcagttttctatggtgattactatgggacaagcggaaatagtagttatgaaattccagcgttaaaagataaaattgatccaattttgacggcacgaaaaaactttgcatatggtacgcagcgtgattatttagaccatccagatgtgattggctggacaagagaaggcgatggtgtacatgctaattctggtttagcgacattactctcggacggaccaggaggatcaaagtggatggatgttggaaagaataacgctggggaagtatggtacgatattacgggtaatcaaacaaatactgtaacaattaataaggacggatgggggcagttctatgtaagtggcggctcagtttccatatatgttcagcggtaa

SEQ ID NO: 70 - protein, 513 aa, Unknown
  Obtained from an environmental sample.
MLKRITVVCLLFILLFPNIYEGNKAEAATVNNGTLMQYFEWYAPNDGNHWNRLRSDAESLAHKGITSVWIPPAYKGTSQNDVGYGAYDLYDLGEFNQKGTVRTKYGTKAQLKSAIDALHKQNIDVYGDVVMNHKGGADYTETVTAVEVDRNNRNIEVSGDYQISAWTGFNFPGRGDAYSNFKWKWYHFDGTDWDEGRKLNRIYKFRGVDKAWDWEVSSENGNYDYLMYADLDFDHPDVANEMKNWGTWYANELNLDGFRLDAVKHIDHEYLRDWVNHARQQTGKEMFTVAEYWQNDVQALNNYLAKVNYNQSVFDAPLHYNFHYASTGNGNYDMRNILNGTVMKNHPALAVTLVENHDSQPGQSLESVVSPWFKPLAYAFILTRAEGYPSVFYGDYYGTSGNSSYEIPALKDKIDPILTARKNFAYGTQRDYLDHPDVIGWTREGDGVHANSGLATLLSDGPGGSKWMDVGKNNAGEVWYDITGNQTNTVTINKDGWGQFYVSGGSVSIYVQR

SEQ ID NO: 71 - DNA, 1311 bp, Artificial Sequence
  Synthetically generated oligonucleotide
atggccaagtacctggagctcgaagagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacacggcccatgcctacggcataaaggtcatagcggacatcgtcataaaccaccgcgcaggcggagacctcgagtggaacccgttcgttggggactacacctggacggacttctcaaaggtagcctcgggcaaatatactgccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgacaacctcgccggaggaagcactgacatcgtttactacgacaacgacgagctgatattcgtgagaaacggctacggaagcaagccgggactgataacatacatcaacctcgcctcaagcaaagccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggggtgggctga

SEQ ID NO: 72 - protein, 436 aa, Artificial Sequence
  Synthetically generated peptide
MAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKVIADIVINHRAGGDLEWNPFVGDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGACIHEYTGNLGGWVDKYVYSSGWVYLEAPAYDPANGQYGYSVWSYCGVG

SEQ ID NO: 73 - DNA, 1299 bp, Unknown
  Obtained from an environmental sample.
atggctctggaagagggcgggcttataatgcaggccttctactgggacgtcccaggtggaggaatctggtgggacaccatagcccagaagatacccgactgggcgagcgccgggatttcggcaatatggattcctcccgcgagtaagggcatgagcggcggctattcgatgggctacgacccctacgatttcttcgacctcggtgagtactaccagaagggaagcgttgagacccgcttcggatcaaaagaggagcttgtgaacatgataaacaccgcccatgctcacaacatgaaggtcatagcggacatagtcatcaaccaccgcgccggcggcgacctggagtggaatcctttcaccaacagctacacctggaccgatttctcgaaggtcgcgtcgggcaagtacacggccaactacctcgacttccacccgaacgagcttcacgcgggcgattccggaacatttggaggctatcccgacatatgccacgacaagagctgggaccagcactggctctgggccagcaacgaaagctacgccgcctacctccggagcatcggcatcgacgcctggcgcttcgactacgtcaagggctacgctccctgggtcgttaagaactggctgaaccggtggggcggctgggcggttggagagtactgggacaccaacgtcgatgcactcctgagctgggcctacgacagcggtgctaaagtcttcgacttcccgctctactacaagatggacgaggccttcgataacaacaacatccccgccctcgtggacgccctcaagaacggaggcacggtcgtcagccgcgacccgttcaaagccgtgaccttcgttgccaaccacgataccaacataatctggaacaagtatccggcctacgccttcatcctcacctatgagggacagccggcaatattctaccgcgactacgaggagtggctcaacaaggacaggctcaggaacctcatctggatacacgaccacctcgcgggaggaagcacagacatcatctactacgacagcgacgagcttatcttcgtgagaaacggctacggggacaagccgggactgataacctacatcaacctcggctcaagcaaggccggaaggtgggtctacgttccgaagttcgcaggctcgtgcatacacgagtacaccggcaacctcggcggctggattgacaagtgggttgactcaagcggtcgggtctaccttgaggcccccgcccacgacccggccaacggccagtacggctactccgtatggagctactgcggtgttgggtga

SEQ ID NO: 74 - protein, 432 aa, Unknown
  Obtained from an environmental sample.
MALEEGGLIMQAFYWDVPGGGIWWDTIAQKIPDWASAGISAIWIPPASKGMSGGYSMGYDPYDFFDLGEYYQKGSVETRFGSKEELVNMINTAHAHNMKVIADIVINHRAGGDLEWNPFTNSYTWTDFSKVASGKYTANYLDFHPNELHAGDSGTFGGYPDICHDKSWDQHWLWASNESYAAYLRSIGIDAWRFDYVKGYAPWVVKNWLNRWGGWAVGEYWDTNVDALLSWAYDSGAKVFDFPLYYKMDEAFDNNNIPALVDALKNGGTVVSRDPFKAVTFVANHDTNIIWNKYPAYAFILTYEGQPAIFYRDYEEWLNKDRLRNLIWIHDHLAGGSTDIIYYDSDELIFVRNGYGDKPGLITYINLGSSKAGRWVYVPKFAGSCIHEYTGNLGGWIDKWVDSSGRVYLEAPAHDPANGQYGYSVWSYCGVG

SEQ ID NO: 75 - DNA, 1299 bp, Unknown
  Obtained from an environmental sample.
atggctctggaagagggcgggcttataatgcaggcattctactgggacgtccccatgggaggaatctggtgggacacgatagcccagaagatacccgactgggcaagcgccgggatttcggcgatatggattccccccgcgagcaagggtatgagcggcggctattcgatgggctacgacccctacgattattttgacctcggtgagtactaccagaagggaacggtggaaacaagattcggctcaaagcaggagctcataaacatgataaacaccgcccacgcctatggcatgaaggtaatagccgatatagtcatcaaccaccgcgccggcggcgatctggagtggaaccccttcgtgaacgactatacctggaccgacttctcgaaggtcgcgtcgggtaaatacacggccaactacctcgacttccacccgaacgagctccacgcgggcgattccggaacatttggaggctatcccgacatatgccacgacaagagctgggaccagtactggctctgggccagccaggagagctacgcggcctatctcaggagcatcggcatcgacgcctggcgcttcgactacgtcaagggctatgctccctgggtcgtcagggactggctgaactggtggggaggctgggcagttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggccagacagtggtcagccgcgacccgttcaaggctgtgacgtttgtagccaaccacgataccgacataatctggaacaagtatccagcctacgcgttcatcctcacctacgagggccagccgacaatattctaccgcgactacgaggagtggctcaacaaggacaagctcaagaacctcatctggatacatgacaacctcgccggagggagcactgacatcgtttactacgacaacgacgagctgatattcgtgagaaacggctacggaagcaagccgggactgataacatacatcaacctcggctcaagcaaagccggaaggtgggtttacgttccgaagttcgcaggctcgtgcatacacgagtacaccggcaacctcggcggctgggtggacaagtgggtggactcaagcggctgggtttacctcgaggctcctgcccacgacccggccaacggccagtacggctactccgtttggagctattgcggtgttgggtga

SEQ ID NO: 76 - protein, 432 aa, Unknown
  Obtained from an environmental sample.
MALEEGGLIMQAFYWDVPMGGIWWDTIAQKIPDWASAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVRDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLGSSKAGRWVYVPKFAGSCIHEYTGNLGGWVDKWVDSSGWVYLEAPAHDPANGQYGYSVWSYCGVG

SEQ ID NO: 77 - DNA, 1299 bp, Unknown
  Obtained from an environmental sample.
atggctctggaagagggcgggctcataatgcaggccttctactgggacgtccccatgggaggaatctggtgggacacgatagcccagaagatacccgactgggcaagcgccgggatttcggcgatatggatccctcccgcgagcaagggtatgagcggcggctattcgatgggctacgacccctacgattattttgacctcggtgagtactaccagaagggaacggtggaaacgaggttcggctcaaagcaggagctcataaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggacgaggccttcgataacaacaacattcccgccctggtggacgccctcagatacggtcagacagtggtcagccgcgacccgttcaaggctgtgacgtttgtagccaaccacgataccgacataatctggaacaagtatccagcctacgcgttcatcctcacctacgagggccagccgacaatattctaccgcgactacgaggagtggctcaacaaggataagctcaagaacctcatctggatacatgacaacctcgccggagggagcactgacatcgtttactacgacaacgacgagctgatattcgtgagaaacggctacggaagcaagccgggactgataacatacatcaacctcgcctcaagcaaagccggaaggtgggtttacgttccgaagttcgcaggctcgtgcatacacgagtacaccggcaatctcggcggctgggtggacaagtgggtggactcaagcggctgggtctacctcgaggctcctgcccacgacccggccaacggccagtacggctactccgtctggagctactgcggtgttgggtga

SEQ ID NO: 78 - protein, 432 aa, Unknown
  Obtained from an environmental sample.
MALEEGGLIMQAFYWDVPMGGIWWDTIAQKIPDWASAGISAIWIPPASKGMSGGYSMGYDPYDYFDLGEYYQKGTVETRFGSKQELINMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNNNIPALVDALRYGQTVVSRDPFKAVTFVANHDTDIIWNKYPAYAFILTYEGQPTIFYRDYEEWLNKDKLKNLIWIHDNLAGGSTDIVYYDNDELIFVRNGYGSKPGLITYINLASSKAGRWVYVPKFAGSCIHEYTGNLGGWVDKWVDSSGWVYLEAPAHDPANGQYGYSVWSYCGVG

SEQ ID NO: 79 - DNA, 1386 bp, Bacterial
atgaagcctgcgaaactcctcgtctttgtgctcgtagtctctatcctcgcggggctctacgcccagcccgcgggggcggccaagtacctggagctcgaagagggcggcgtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctacggcatcaaggtcatcgcagacatagtaatcaaccaccgcgccggaggagaccttgagtggaaccccttcgtcaatgactacacctggacggacttctcgaaggtcgcttccggcaagtacacggccaactacctcgacttccaccccaacgaggtcaagtgctgcgacgagggcacctttggagggttcccggacatagcccacgagaagagctgggaccagtactggctctgggcgagcaacgagagctacgccgcctacctcaggagcatcggcgttgacgcatggcgcttcgactacgtcaagggctacggagcgtgggtcgtcaaggactggctggactggtggggaggctgggccgtcggggagtactgggacacaaacgttgatgcactgctcaactgggcctactcgagcgatgcaaaagtcttcgacttcccgctctactacaagatggacgcggcctttgacaacaagaacattcccgcactcgtcgaggccctcaagaacgggggcacagtcgtcagccgcgacccgtttaaggccgtaaccttcgttgcaaaccacgacacggacataatttggaacaagtacccggcctacgccttcatcctcacctacgagggccagccgacgatattctaccgcgactacgaggagtggctcaacaaggacaggctcaagaacctcatctggatacacgaccacctcgccggtggaagcaccgacatagtctactacgataacgatgaactcatcttcgtcaggaacggctacggggacaagccggggcttataacctacatcaacctaggctcgagcaaggccgggaggtgggtctacgttccgaagttcgcgggagcgtgcatccacgagtacaccggcaacctcggcggctgggtggacaagtgggtggactcaagcgggtgggtgtacctcgaggcccctgcccacgacccggccaacggctattacggctactccgtctggagctactgcggggtgggctga

SEQ ID NO: 80 - protein, 461 aa, Bacterial
MKPAKLLVFVLVVSILAGLYAQPAGAAKYLELEEGGVIMQAFYWDVPSGGIWWDTIRQKIPEWYDAGISAIWIPPASKGMGGAYSMGYDPYDFFDLGEYDQKGTVETRFGSKQELVNMINTAHAYGIKVIADIVINHRAGGDLEWNPFVNDYTWTDFSKVASGKYTANYLDFHPNEVKCCDEGTFGGFPDIAHEKSWDQYWLWASNESYAAYLRSIGVDAWRFDYVKGYGAWVVKDWLDWWGGWAVGEYWDTNVDALLNWAYSSDAKVFDFPLYYKMDAAFDNKNIPALVEALKNGGTVVSRDPFKAVTFVANHDTDIIWNKYPAYAFILTYEGQPTIFYRDYEEWLNKDRLKNLIWIHDHLAGGSTDIVYYDNDELIFVRNGYGDKPGLITYINLGSSKAGRWVYVPKFAGACIHEYTGNLGGWVDKWVDSSGWVYLEAPAHDPANGYYGYSVWSYCGVG

SEQ ID NO: 81 - DNA, 1386 bp, Bacterial
atgaagaagtttgtcgccctgttcataaccatgtttttcgtagtgagcatggcagtcgttgcacagccagctagcgccgcaaagtattccgagctcgaagaaggcggcgttataatgcaggccttctactgggacgtcccaggtggaggaatctggtgggacaccatcaggagcaagataccggagtggtacgaggcgggaatatccgccatttggattccgccagccagcaaggggatgagcggcggttactcgatgggctacgatccctacgatttctttgacctcggcgagtacaaccagaagggaaccatcgaaacgcgctttggctctaaacaggagctcatcaatatgataaacacggcccatgcctacggcataaaggtcatagcggacatcgtcataaaccaccgcgcaggcggagacctcgagtggaacccgttcgttggggactacacctggacggacttctcaaaggtggcctcgggcaaatatactgccaactacctcgacttccaccccaacgaggtcaagtgctgtgacgagggcacatttggaggcttcccagacatagcccacgagaagagctgggaccagcactggctctgggcgagcgatgagagctacgccgcctacctaaggagcatcggcgttgatgcctggcgctttgactacgtgaagggctacggagcgtgggtcgtcaaggactggctcaactggtggggcggctgggccgttggcgagtactgggacaccaacgttgatgcactcctcaactgggcctactcgagcggcgccaaggtcttcgacttcccgctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtaccttgcttatgctttcatcctcacctacgaaggccagcccgtcatattctaccgcgactacgaggagtggctcaacaaggacaggttgaacaacctcatatggatacacgaccacctcgcaggtggaagcacgagcatagtctactacgacagcgacgagatgatcttcgtgaggaacggctatggaagcaagcctggccttataacttacatcaacctcggctcgagcaaggttggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctattgcggtgttgggtga

SEQ ID NO: 82 - protein, 461 aa, Bacterial
MKKFVALFITMFFVVSMAVVAQPASAAKYSELEEGGVIMQAFYWDVPGGGIWWDTIRSKIPEWYEAGISAIWIPPASKGMSGGYSMGYDPYDFFDLGEYNQKGTIETRFGSKQELINMINTAHAYGIKVIADIVINHRAGGDLEWNPFVGDYTWTDFSKVASGKYTANYLDFHPNEVKCCDEGTFGGFPDIAHEKSWDQHWLWASDESYAAYLRSIGVDAWRFDYVKGYGAWVVKDWLNWWGGWAVGEYWDTNVDALLNWAYSSGAKVFDFPLYYKMDEAFDNKNIPALVSALQNGQTVVSRDPFKAVTFVANHDTDIIWNKYLAYAFILTYEGQPVIFYRDYEEWLNKDRLNNLIWIHDHLAGGSTSIVYYDSDEMIFVRNGYGSKPGLITYINLGSSKVGRWVYVPKFAGACIHEYTGNLGGWVDKYVYSSGWVYLEAPAYDPANGQYGYSVWSYCGVG

SEQ ID NO: 83 - DNA, 1299 bp, Unknown
  Obtained from an environmental sample.
atggctctggaagacggcgggctcataatgcaggccttctactgggatgttcctggaggaggaatctggtgggacacaatagctcaaaagatacccgaatgggcaagtgcaggaatctcagcgatatggattccaccagcgagtaagggcatgagcggtggttattccatgggctacgatccctacgatttctttgacctcggcgagtactatcagaaggggacagttgagacgcgcttcggctcaaaggaagaactggtgaacatgataaacaccgcacactcctacggcataaaggtgatagcagacatagtcataaaccaccgcgccggtggagaccttgagtggaaccccttcgtgaacgactatacctggacagacttctcaaaagtcgcctccggtaaatatacggccaactaccttgacttccacccaaacgagcttcactgttgtgatgaaggtacctttggaggataccctgatatatgtcacgacaaaagctgggaccagtactggctctgggcgagcagcgaaagctacgctgcctacctcaggagcataggggttgacgcctggcgtttcgactacgtcaagggctacggagcatgggttgttaacgactggctcagctggtggggaggctgggccgttggagagtactgggacacgaacgttgatgcactcctcaactgggcatacagcagcggcgccaaggtctttgacttcccgctctactacaagatggacgaagccttcgacaacaccaacatcccggcattagtggatgcactcagatacggccagacagtggtcagccgcgatcccttcaaggcggtaactttcgttgccaaccacgatacagatataatctggaacaagtatccggcttatgcattcatccttacctatgagggacagcctgttatattctaccgcgactacgaggagtggctcaacaaggataagcttaacaacctcatctggatacacgatcaccttgctggagggagtactgacattgtttactacgacagcgacgagcttatctttgtgagaaacggctatggcaccaaaccaggactgataacctatatcaacctcggctcaagcaaagttggaaggtgggtctacgttccaaagttcgccggttcatgcatccacgagtacaccggcaacctcggcggttggatagacaagtacgtctcctccagcggctgggtctatcttgaggccccagcccacgacccggcgaacggctactacggctactccgtatggagctactgcggggttgggtga

SEQ ID NO: 84 - protein, 432 aa, Unknown
  Obtained from an environmental sample.
MALEDGGLIMQAFYWDVPGGGIWWDTIAQKIPEWASAGISAIWIPPASKGMSGGYSMGYDPYDFFDLGEYYQKGTVETRFGSKEELVNMINTAHSYGIKVIADIVINHRAGGDLEWNPFVNDYTWTDFSKVASGKYTANYLDFHPNELHCCDEGTFGGYPDICHDKSWDQYWLWASSESYAAYLRSIGVDAWRFDYVKGYGAWVVNDWLSWWGGWAVGEYWDTNVDALLNWAYSSGAKVFDFPLYYKMDEAFDNTNIPALVDALRYGQTVVSRDPFKAVTFVANHDTDIIWNKYPAYAFILTYEGQPVIFYRDYEEWLNKDKLNNLIWIHDHLAGGSTDIVYYDSDELIFVRNGYGTKPGLITYINLGSSKVGRWVYVPKFAGSCIHEYTGNLGGWIDKYVSSSGWVYLEAPAHDPANGYYGYSVWSYCGVG

SEQ ID NO: 85 - DNA, 1299 bp, Unknown
  Obtained from an environmental sample.
atggctctggaagagggcgggcttataatgcaggcattctattgggacgtcccaggtggaggaatctggtgggacaccatagcccagaagatacccgaatgggcaagtgcaggaatctcagcgatatggattccaccagcgagtaagggaatgagcggtggttattccatgggctacgatccctacgatttctttgacctcggcgagtactatcagaaggggacagttgagacgcgcttcggctcaaaggaagaactggtgaacatgataaacaccgcacactcctacggcataaaggtgatagcggacatagtcataaaccaccgcgccggtggaggcctcgagtggaaccccttcgtgaacgactatacctggacagacttctcaaaagtcgcctccggtaaatatacagccaactaccttgacttccacccaaacgagcttcactgttgtgatgaaggtacctttggaggataccctgatatatgtcacgacaaaagctgggaccagtactggctctgggcgagcagcgaaagctacgctgcctacctcaggagcataggggttgacgcctggtgtttcgactacgtcaagggctacggagcctgggttgttaacgactggctcagctggtggggaggctgggccgttggagagtactgggacactaacgttgatgcactcctcaactgggcatacaacagcggcgccaaggtctttgacttcccgctctactacaagatggacgaagccttcgacaataccaacatccccgctttggtttacgccctcaagaatggcgggacagtggtcagccgcgacccattcaaggcggtaactttcgttgccaaccacgatacagatataatctggaacaagtatccggcttatgcattcatccttacctatgagggacagcctgttatattctaccgcgactacgaggagtggctcaacaaggataagcttaacaacctcatctggatacacgatcaccttgctggagggagtactgacattgtttactacgacagcgacgagcttatctttgtgagaaacggctatggcaccaaaccaggactgataacctatatcaacctcggctcaagcaaagctggaaggtgggtctacgttccaaagttcgccggttcatgcatccacgagtacaccggcagcctcggcggttggatagacaagtacgtctcctccagcggctgggtctaccttgaggccccggcccacgacccggccaatggccagtatggctactccgtctggagctattgcggggttgggtga

SEQ ID NO: 86 - protein, 432 aa, Unknown
  Obtained from an environmental sample.
MALEEGGLIMQAFYWDVPGGGIWWDTIAQKIPEWASAGISAIWIPPASKGMSGGYSMGYDPYDFFDLGEYYQKGTVETRFGSKEELVNMINTAHSYGIKVIADIVINHRAGGGLEWNPFVNDYTWTDFSKVASGKYTANYLDFHPNELHCCDEGTFGGYPDICHDKSWDQYWLWASSESYAAYLRSIGVDAWCFDYVKGYGAWVVNDWLSWWGGWAVGEYWDTNVDALLNWAYNSGAKVFDFPLYYKMDEAFDNTNIPALVYALKNGGTVVSRDPFKAVTFVANHDTDIIWNKYPAYAFILTYEGQPVIFYRDYEEWLNKDKLNNLIWIHDHLAGGSTDIVYYDSDELIFVRNGYGTKPGLITYINLGSSKAGRWVYVPKFAGSCIHEYTGSLGGWIDKYVSSSGWVYLEAPAHDPANGQYGYSVWSYCGVG

SEQ ID NO: 87 - DNA, 1419 bp, Unknown
  Obtained from an environmental sample.
atgttcctgctcgcgtttttgctcactgcctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgctgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgaccgagctgaaaaactgggggaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacagacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccgggctggccgcactgatcaccgatgggccgggaggaagcaaatggatgtactgttggcaaacaacacgctggaaaagtgttctatga

SEQ ID NO: 88 - protein, 472 aa, Unknown
  Obtained from an environmental sample.
MFLLAFLLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTDGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYCWQTTRWKSVL

SEQ ID NO: 89 - DNA, 3301 bp, Bacterial
atgaaagaagcggttgtgtatcaaattttcccggatcggttctttaatggcaacccttcaaatgataacagcaagcagcaggcacgcggggcgcagccgattgagcatcgcgattggtcggatttgcccgataatccgcgcctgaaagggacgagcggctacgatggcgacggtgaatggtcgaatgactttttcggcggagacatcgccggaattgaacaaaagttggattatttgcagtcgcttggagtgaacacgatttacttaaatccgatcgccaatgcgccatcgaaccataaatatgatgcgagcaattacaaagaattggatccgatgttcggttccccggaagaattccaatcgtttgtgcaggcgcttgcgaaccgggggatgcatctcatcttagacggggtgttcaaccacgtatccgacgattcgatttactttgaccgctaccaccgctatccgaccgtcggtgcgtatgaatattgggaagcggtttacgatttgatgaatgaaaaaggattgagcgaggaagaagcgcggaaacaagtggaagagaagttcaaacaagagggacagacgttcagcccgtatgggtttcatctttggttcaatattgaaaacaaaaaagtcaatggccattatcaataccaatcatggtggggctatgacagtctgccggagtttaagtcggtgacgggggaaaaagtgccgcatccgagtgaattgaacaacgatgcgctcgcgaattacattttccgtgaatcggattcggtggcgaaaagctggattgccctcggcgcctccggctggcggttggatgtggccaatgaggtggatccggcgttttggcgcgagtttcgccaagaattgcttcaagggtcgtacggccgcggtccgacgttaaaagagggggagcagccgctcattttaggggaaatttgggatgacgcatcgaaatattttctaggcgaccagtacgattccgtgatgaactaccggttccgcggggcggtgcttgactttttgaaaaacggaaatgcagaagaggcggacaagcggctgacggccataagggaagactacccaagtgaagcgttttatgcgctgatgaacttaatcggttcgcatgacacggcgcgggcggtctttctgcttgggaacggaacggattcatccgagcgggcggagcttgatccgaattataatgaggaacttgggaaaaagcggctcaagctggcggtgattttgcagatgggatacccgggagcgccgacgatttattacggcgatgaagcgggagtaacaggctcaaaagacccagacaaccgccgcacgtatccgtggggcaaagaagatcaaaatctgttgtcccattatcagaaagtggggcacattcgccagcaccatcaatcgttgttggcccatggcgacatcaagacggtgtatgcgcaaggggatgtatacgtatttgcccgccaatacgggcgtgaagcggcgctcattgccatcaaccgcggcaatgaggacaagacggtggcgcttgacgtcgcttcgttgcttccgaacggcaccgtgcttacggatgagttgcatgatggcggggaagctacggtcgctggcggaacgttgacggtcacgattccggccctggatggacggatgatgtttgggacggtgacggcggaaatgccggcagcagtcagcaatttgcaggcgagcgcttcggatggctgcgtgacgttaacgtgggaaggaaatgcatcgagataccgaatttacgagtccacgttaaaaggtgccggttatacgatggtgcaagagacggaaacaacttcggccacgatcggttcgttgacgaacggaacagcctattactttgccgttgcggcggtcgatgaaaacgggaatgaatcaccgaaggtcgaaacgaatcgcgtcgttcctcattacccgctgacgagcgacaatgtccagttcgtgacaacgttaagcgatgccacactggatttgtcaaagccgcagcaagtggatgtccatgtcaacatcgacaatgtgacaagcaaaggagcagctgatgggttgcaagcggtgttgcaagtgaaaggcccgcatgacgaaacatggaaagaatacagagcggcttaccaaggacaagacggcgacgccaacgtgttccgagctgccttcactccgctcgccgcagggacgtatacgtatcgttatgcgctgacgaccaaccttggcgaggagtggatgtatacagaagagaagcaagtgacgtttgcggcagacaacagcgaccaaatagcgccagcagacgccatcgagctgcggcagcctgcggttgaatcgggacaagtgaatttatcatggacgtttgttgggaaaaaagatggggatgcttatttgttagccatcgagcgcaacggtgatatcgtgcatacaaccacttcgatcggcgattcatttacagactacgatgtcgaaaacggcaccgagtacacgtatgttgtcaagttgtatgaccgcgccggcaatgttgtggcgtcaaacacggtcaaggtgacgccggacattgtgatggtgaaagtgatttttaaagtgagagcgccggattacacaccgttggatgcccgaattacgattccgaacagcttgaacggctggaacacaggggcctgggagatgtcgcgcaacggtgcggtgacgcccgattggcaatttaccgtcgaggtgcaggaaggggaaacgatcacctataagtatgtgaaaggcggatcgtgggatcaagaggggttggccgaccatacgcgtgaggacgacaacgatgatgacgtgagctactacggctatgggacgattggcaccgacttgaaagtgacggtccacaatgaaggaaacaatacgatgattgtgcaagaccgcattttgcgctggatcgatatgccggtcgtcatcgaagaggtgcaaaaacaaggaagtcaagtgacgatcaagggcaatgccattaaaaacggtgttttgacgatcaatggcgagcgggtgccgattgatggccggatggcattctcgtacacgtttgcgccggccagccatcaaaaagaagtgttgatccatatcgaaccatcggccgaaagcaaaacagccattttcaacaacgacggcggagcgattgcgaaaaacacaaaagattacgtgctgaatttagaaacgaagcaattcaaaaagcttctcgagagtacttctagagcggccgcgggcccatcgattttccacccgggtggggtaccaggta

SEQ ID NO: 90 - protein, 1100 aa, Bacterial
MKEAVVYQIFPDRFFNGNPSNDNSKQQARGAQPIEHRDWSDLPDNPRLKGTSGYDGDGEWSNDFFGGDIAGIEQKLDYLQSLGVNTIYLNPIANAPSNHKYDASNYKELDPMFGSPEEFQSFVQALANRGMHLILDGVFNHVSDDSIYFDRYHRYPTVGAYEYWEAVYDLMNEKGLSEEEARKQVEEKFKQEGQTFSPYGFHLWFNIENKKVNGHYQYQSWWGYDSLPEFKSVTGEKVPHPSELNNDALANYIFRESDSVAKSWIALGASGWRLDVANEVDPAFWREFRQELLQGSYGRGPTLKEGEQPLILGEIWDDASKYFLGDQYDSVMNYRFRGAVLDFLKNGNAEEADKRLTAIREDYPSEAFYALMNLIGSHDTARAVFLLGNGTDSSERAELDPNYNEELGKKRLKLAVILQMGYPGAPTIYYGDEAGVTGSKDPDNRRTYPWGKEDQNLLSHYQKVGHIRQHHQSLLAHGDIKTVYAQGDVYVFARQYGREAALIAINRGNEDKTVALDVASLLPNGTVLTDELHDGGEATVAGGTLTVTIPALDGRMMFGTVTAEMPAAVSNLQASASDGCVTLTWEGNASRYRIYESTLKGAGYTMVQETETTSATIGSLTNGTAYYFAVAAVDENGNESPKVETNRVVPHYPLTSDNVQFVTTLSDATLDLSKPQQVDVHVNIDNVTSKGAADGLQAVLQVKGPHDETWKEYRAAYQGQDGDANVFRAAFTPLAAGTYTYRYALTTNLGEEWMYTEEKQVTFAADNSDQIAPADAIELRQPAVESGQVNLSWTFVGKKDGDAYLLAIERNGDIVHTTTSIGDSFTDYDVENGTEYTYVVKLYDRAGNVVASNTVKVTPDIVMVKVIFKVRAPDYTPLDARITIPNSLNGWNTGAWEMSRNGAVTPDWQFTVEVQEGETITYKYVKGGSWDQEGLADHTREDDNDDDVSYYGYGTIGTDLKVTVHNEGNNTMIVQDRILRWIDMPVVIEEVQKQGSQVTIKGNAIKNGVLTINGERVPIDGRMAFSYTFAPASHQKEVLIHIEPSAESKTAIFNNDGGAIAKNTKDYVLNLETKQFKKLLESTSRAAAGPSIFHPGGVPG

SEQ ID NO: 91 - DNA, 1650 bp, Bacterial
gtgctaacgtttcaccgcatcattcgaaaaggatggatgttcctgctcgcgtttttgctcactgcctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttataaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgacttggacatggaccatcctgaagtggttacggaactgaaaaactggggcaaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcatcccacaatataacattccttcgctgaaaagcaaaatcgatccgctcctcatcgcgcgcagggattatgcttacggaacgcaacatgattatcttgatcactccgacatcatcgggtggacaagggaaggcgtcactgaaaaaccaggatccggactggccgcactgatcaccgatgggccgggaggaagcaaatggatgtacgttggcaaacaacacgccggaaaagtgttctatgaccttaccggcaaccggagtgacaccgtcaccatcaacagtgatggatggggagaattcaaagtcaatggcggttcggtttcggtttgggttcctagaaaaacgaccgtctctaccatcgcttggccgatcacaacccgaccgtggactggtgaattcgtccgttggaccgaaccacggttggtggcatggccttga

SEQ ID NO: 92 - protein, 549 aa, Bacterial
VLTFHRIIRKGWMFLLAFLLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWPITTRPWTGEFVRWTEPRLVAWP

SEQ ID NO: 93 - DNA, 1545 bp, Bacterial
atgaaatcgtttgcattcatgcctatccttttttatgcaaacgatttcatcagtgaaagggaaggaggaggaaaaatggggaagaatatgagaagaagattcacgtatttttcaatcttcttattgttcgttcagctgttttcatttagtgcaaccgctagcgccaatggaacggtgaacagtagtcctgtggttaatggaaacgaagtcacgtttctatatggaggaacaggaaacgagcagtctgtgttactggcaggctcctttaatgattggcagaaagatggtgacaagaagattgcactaacaaaaggcgacaataacgtctggtctgtcacgcaaacacttcaagatgggacatatacgtataagtttgttgtagatggtcaatgggtggcggatccgcttaacccgaatcaagtagacgacggttacggcggccgtaatagtgtcgttgttgtcgggacaccggtgcaacaagaacggacagtgacgcttgttggtaacttacaagacgaattaggtcatacgagcgaatgggatccgaaagcgacagctacagtgatgaaaaaggaagggaacgggttatatacgtttacaggtacacttccagccggaacgtacgagtataaaattgcgattaatggcagctgggacgaaaactatggtgtcggcggccgcgatggcgggaatattaagctgctattaaatgaacaaacaacggttacattttattacaacgacagaacgcatgcgattgcggattcgacttggtatgcaccaattctaaaagaaaagcagccgcggctcgttggaacgattttaccagctattggttatgaaacagacgtgaacggttggacgccgcaaacatcaacggcgttgttgtcagatgatgattttgattccatttatacgtttaaggcgcgtgtgccaaaagggacatatgaatataaagtagttcttgggaatgattggacatatgaaaattatccacaagataatgccaaattaaatgtgcttgaagaaacgacaattacctttttctttaacgcgaaaacgaaagtagtgtataccgattacaatccaagcggttcggatggtatcgtccaaaaagaccgtttgaagcataatacgtgggattcgttgtatcgccaaccgtttggtgcggtgaaagctgggacagaagtgacccttcgtttatcagcgaaaaaaggtgatttgacaaaagcggatgtatatgtaaaaaatacgacaaccggcacagcgaaactatattcgatgaaaaaagccggtgttcttggcgaagaagaatattgggaagcgacattcacaccggatgtgaaaggagtatacggttataaatttattgcggtagatgctggaacgaaagcagaatacggggaagatacacaagaagggcagtggggaaaagcagtagataaaaatgcagagctgttccaattaacggtgtacgacccatcctaccaaacaccggattggatgaaagaagcagttgtatatcaaattttccctgatccaaag

SEQ ID NO: 94 - protein, 515 aa, Bacterial
MKSFAFMPILFYANDFISEREGGGKMGKNMRRRFTYFSIFLLFVQLFSFSATASANGTVNSSPVVNGNEVTFLYGGTGNEQSVLLAGSFNDWQKDGDKKIALTKGDNNVWSVTQTLQDGTYTYKFVVDGQWVADPLNPNQVDDGYGGRNSVVVVGTPVQQERTVTLVGNLQDELGHTSEWDPKATATVMKKEGNGLYTFTGTLPAGTYEYKIAINGSWDENYGVGGRDGGNIKLLLNEQTTVTFYYNDRTHAIADSTWYAPILKEKQPRLVGTILPAIGYETDVNGWTPQTSTALLSDDDFDSIYTFKARVPKGTYEYKVVLGNDWTYENYPQDNAKLNVLEETTITFFFNAKTKVVYTDYNPSGSDGIVQKDRLKHNTWDSLYRQPFGAVKAGTEVTLRLSAKKGDLTKADVYVKNTTTGTAKLYSMKKAGVLGEEEYWEATFTPDVKGVYGYKFIAVDAGTKAEYGEDTQEGQWGKAVDKNAELFQLTVYDPSYQTPDWMKEAVVYQIFPDPK

SEQ ID NO: 95 - DNA, 1524 bp, Bacterial
atgtatacactattcatccgttcatattttgatactgatggtgatggtgtaggagactttagtggagttgctgaaaaggtagattatctaaaatctcttggagtagatacagtctggtttttaccatttaataaaagtaaatcttatcatggatatgatgttgaagattactatgatgtagaaccagattatggaacactacaagatcttgataatatgataaaagttctaaatgaaaatggaataaaggtagtaatggatcttgttgttaatcatacgtcggatacacatccatggtttcttgatgcagttgaaaatactactaattctccatattggaactattacattatgagcttggatgagcctcaaaataagaatcattggcattataaggttaattcaaaaggacaaactgtgtggtattttggattgtttgattcatcaatgccggaccttaattacgacaaccctaaagtaatggatgaagtgaaaaaaataatagatttttgggcagatatgggagtagatggatttagattagatgcagcaaaacattattatggatttgactggagcgatggaattgaacagtcagcaagcgttgcaaaagagatagaagactatataaaagataaactaggggaaaatgcaatagttgtgagtgaggtttacgatggagattcaaatgttcttttaaaatttgctccaatgcctgtgtttaattttagttttatgtacaatttgagaggaaattttgaagggagagataacttaatttcagactctattagttgggttgattcctcgttgtataatttaaatgtttttcattttccatttattgatagtcatgatcttgacagatttatttctgagcttgtagatagtaaatatcagggagatgtaatatctgccacaaaacaatatttgctagttaatgctttactactctcattaacaggcatgccaactatttactatggtgatgaaataggacttaggggatggaagtggcattcagaaccatgggatatacctgtgcgtgagccaatgcaatggtataaggatcaaaaagggaacggtcaaacttattggacaaaagagttttacgaaggtattactgaaggaagtgctaatgaagatggagcaatatacgatgatccagatgatggagtatctgtagaagaacaagaaaatggatattctattttaaacttttttaaagaatttatcaacttacgaaaagattatccggcacttgcttttggaagtactacgattgagagagattggaaaaacttgtatgttttgaaaaagtcgtataacttccaggatgttcttgtattaattaaccttgatccaacgtattcaaatacatacgaagttccagaagggtataaatgggtgtggtatgcattttttgatggtgacaactatgaatttggagcaaaagatgaaatgattttacagaatacaagttggacgataaatccaaggcaaatttatatatttgtaaagtaa

SEQ ID NO: 96 - protein, 507 aa, Bacterial
MYTLFIRSYFDTDGDGVGDFSGVAEKVDYLKSLGVDTVWFLPFNKSKSYHGYDVEDYYDVEPDYGTLQDLDNMIKVLNENGIKVVMDLVVNHTSDTHPWFLDAVENTTNSPYWNYYIMSLDEPQNKNHWHYKVNSKGQTVWYFGLFDSSMPDLNYDNPKVMDEVKKIIDFWADMGVDGFRLDAAKHYYGFDWSDGIEQSASVAKEIEDYIKDKLGENAIVVSEVYDGDSNVLLKFAPMPVFNFSFMYNLRGNFEGRDNLISDSISWVDSSLYNLNVFHFPFIDSHDLDRFISELVDSKYQGDVISATKQYLLVNALLLSLTGMPTIYYGDEIGLRGWKWHSEPWDIPVREPMQWYKDQKGNGQTYWTKEFYEGITEGSANEDGAIYDDPDDGVSVEEQENGYSILNFFKEFINLRKDYPALAFGSTTIERDWKNLYVLKKSYNFQDVLVLINLDPTYSNTYEVPEGYKWVWYAFFDGDNYEFGAKDEMILQNTSWTINPRQIYIFVK

SEQ ID NO: 97 - DNA, 2931 bp, Bacterial
atgaggaagaagatgtcgcattcaagatttacttttcttttgatcttagcactttttattttcttctccggttgtatttcagaagttaaaagcgaaagccagctactaaattcaaagcaaaaggtccttgtaaaagtaaatgttaatacgccatttattgagaatgctactactaatacgtggagtgtttcaaaagaatcttttattgattatcttagtaaagtgattattactgttaaggatgtaaatgatcagattgtatttactaaggaaacaacgaacaaaacaaatatttattttgaaattgaacttcttcctggaacttatacatttgaggtaaaaggatatgaggaagatttagttatattttcaggggaaaaagttaatcagatcatagatgagaaaaataatattgttaatgtcgaaactttttttgttaatggaatagttaggacaataattgaagttgacgatattatttataaaaattatgatattacatcggcaacgttgatcttcaaaaaagatacagcacaagaagattatgaagaggtacctgtaacacttacaggtacttccactttaattaataaagaattatatcctggtatgtggactgtaaaatttgaagttgatcttaaatcaaaggatgcaagtatgttaccagaaaaagttcatcttgaaaatgaatttagcatagaagtgcttccagcaaagacaaaaagtttaacatttaatgtagtctttgatacagaggttaatgaaccgaaattagtagttgtatttccgcaaattgagttgccttttgtggatcctgtaacaaatttaagtggagagataaatgaattagaagggaatctttcaatgaattgggactattcagatccaaatgcagaattttatgtgtataaagaattagaggaacaaggagaatatttgtatgaatttgttggaaaaacacgcgagaaaagttatacaatagaaaattttaccaagcaagaattcgataaatttagtggaatcgctattaatgtttatgccaacggtaaagagagtggattagttgttctaaaaaaagaaaatattaaacttatagatttagaaagtgttgacagtataagtgctacttataacgttgatacgaatgagcttaagttggattggaattataccaattcaagtgttacttttgaagttttgaaaaaaggtataaatagcaatgaatacgaaataatttctcaactaacacaaaattctttttcaacagaattcacaggcaggcaattttgggatcttgagaaaattgcgattagagtagttgctaatggatttgaaagtaagattaatgagatttcaagagatgatataactataacatcattgaatcttcctcttacatcgtctactatgtatacactattcatccgttcatattttgatactgatggtgatggtgtaggagactttagtggagttgctgaaaaggtagattatctaaaatctcttggagtagatacagtctggtttttaccatttaataaaagtaaatcttatcatggatatgatgttgaagattactatgatgtagaaccagattatggaacactacaagatcttgataatatgataaaagttctaaatgaaaatggaataaaggtagtaatggatcttgttgttaatcatacgtcggatacacatccatggtttcttgatgcagttgaaaatactactaattctccatattggaactattacattatgagcttggatgagcctcaaaataagaatcattggcattataaggttaattcaaaaggacaaactgtgtggtattttggattgtttgattcatcaatgccggaccttaattacgacaaccctaaagtaatggatgaagtgaaaaaaataatagatttttgggcagatatgggagtagatggatttagattagatgcagcaaaacattattatggatttgactggagcgatggaattgaacagtcagcaagcgttgcaaaagagatagaagactatataaaagataaactaggggaaaatgcaatagttgtgagtgaggtttacgatggagattcaaatgttcttttaaaatttgctccaatgcctgtgtttaattttagttttatgtacaatttgagaggaaattttgaagggagagataacttaatttcagactctattagttgggttgattcctcgttgtataatttaaatgtttttcattttccatttattgatagtcatgatcttgacagatttatttctgagcttgtagatagtaaatatcagggagatgtaatatctgccacaaaacaatatttgctagttaatgctttactactctcattaacaggcatgccaactatttactatggtgatgaaataggacttaggggatggaagtggcattcagaaccatgggatatacctgtgcgtgagccaatgcaatggtataaggatcaaaaagggaacggtcaaacttattggacaaaagagttttacgaaggtattactgaaggaagtgctaatgaagatggagcaatatacgatgatccagatgatggagtatctgtagaagaacaagaaaatggatattctattttaaacttttttaaagaatttatcaacttacgaaaagattatccggcacttgcttttggaagtactacgattgagagagattggaaaaacttgtatgttttgaaaaagtcgtataacttccaggatgttcttgtattaattaaccttgatccaacgtattcaaatacatacgaagttccagaagggtataaatgggtgtggtatgcattttttgatggtgacaactatgaatttggagcaaaagatgaaatgattttacagaatacaagttggacgataaatccaaggcaaatttatatatttgtaaagtaa

SEQ ID NO: 98 - protein, 976 aa, Bacterial
MRKKMSHSRFTFLLILALFIFFSGCISEVKSESQLLNSKQKVLVKVNVNTPFIENATTNTWSVSKESFIDYLSKVIITVKDVNDQIVFTKETTNKTNIYFEIELLPGTYTFEVKGYEEDLVIFSGEKVNQIIDEKNNIVNVETFFVNGIVRTIIEVDDIIYKNYDITSATLIFKKDTAQEDYEEVPVTLTGTSTLINKELYPGMWTVKFEVDLKSKDASMLPEKVHLENEFSIEVLPAKTKSLTFNVVFDTEVNEPKLVVVFPQIELPFVDPVTNLSGEINELEGNLSMNWDYSDPNAEFYVYKELEEQGEYLYEFVGKTREKSYTIENFTKQEFDKFSGIAINVYANGKESGLVVLKKENIKLIDLESVDSISATYNVDTNELKLDWNYTNSSVTFEVLKKGINSNEYEIISQLTQNSFSTEFTGRQFWDLEKIAIRVVANGFESKINEISRDDITITSLNLPLTSSTMYTLFIRSYFDTDGDGVGDFSGVAEKVDYLKSLGVDTVWFLPFNKSKSYHGYDVEDYYDVEPDYGTLQDLDNMIKVLNENGIKVVMDLVVNHTSDTHPWFLDAVENTTNSPYWNYYIMSLDEPQNKNHWHYKVNSKGQTVWYFGLFDSSMPDLNYDNPKVMDEVKKIIDFWADMGVDGFRLDAAKHYYGFDWSDGIEQSASVAKEIEDYIKDKLGENAIVVSEVYDGDSNVLLKFAPMPVFNFSFMYNLRGNFEGRDNLISDSISWVDSSLYNLNVFHFPFIDSHDLDRFISELVDSKYQGDVISATKQYLLVNALLLSLTGMPTIYYGDEIGLRGWKWHSEPWDIPVREPMQWYKDQKGNGQTYWTKEFYEGITEGSANEDGAIYDDPDDGVSVEEQENGYSILNFFKEFINLRKDYPALAFGSTTIERDWKNLYVLKKSYNFQDVLVLINLDPTYSNTYEVPEGYKWVWYAFFDGDNYEFGAKDEMILQNTSWTINPRQIYIFVK

SEQ ID NO: 99 - DNA, 1536 bp, Bacterial
atgtacacactcttcatccgctctttttacgatacaaacaacgacggtgtaggtgactacaacggtgttgcccaaaaagtagactatctcaaaacgcttggagtggatacagtttggttcttgccgttcaacaaagcaaaatcgtaccacggttacgatgttgaagactactacgatgtagaacctgactatggaacatacgcacaacttgaaaatatgataaagacactcaatcagaacggaattcgtgttgttatggacttggttgtgaaccacacttccgatacacactcgtggtttctggatgccgttgagaacacaacgaattcgaaatattggagctactacataatgacacttgaaaatagagacggttggaatcactggcattggaagataaactcaaaagggcaaaaagtttactacttcggactgtttgactcatcaatgcccgatttgaatttcgacaatccacaagtgatgaacgaaatcaagagaataatcgatttctggataacagttggtgtggatggtttcagacttgatgcaccaaagcactacaaaggctgggattgggacgacggcatttcaggttcagcagcaatcgcgagggaaatagaaagttacatcaggagcaagttaggaaacgatgcgatagttgtcggggaagtgtacgatggaaatccatcggttctttcacaatttgcaccgatgccggcgttcaacttcacattcatgtatggaataacaggcaaccatgaggggaaagataacctgctgggagaaacaatttcatgggttaatggagcgagttattatctcaacgtaaaacatttcccgttcatagacaatcacgatttgaacagatggatatcgatacttatcgaccaaaagtatagtggaaacacacaagttggtacgaagcagtatattttaacaaatgcgctcttgctttccttaaacggtatgcctgttatttattatgggaatgaaataggcttgagaggatggaaatggggacaagacccgtgggatttgccggtgagagagccgatgcagtggtacgcaagtcaaagtggagctgggcagacatggtggacaaagcctgtctaccagcaaaaaggaatcacatttggaaatgcaaacgtcgatggtgcgatgtacgatgatccaaatgatggggtttcagtagaagagcagatgaatggttacacgataaataacttctttaaacaattcataaccctgaggaagacatatccggctctatcgaaaggttcgataacgatagaacgcgactggaagaacctgtacgttatcaaacgagtctacggaaatcaggaagtgcttgtattgataaacttagacccaacttggccgaacaattacacgttaccaggtggatacaggtgggtctggtatgcgttctttaatgggagtttgtttgaatttggcaataaaaacgaatcaccactgagccaagataccaactggacagtcaatccaaggcaagtgtatgtgtttgtgaaggactaa

SEQ ID NO: 100 - protein, 511 aa, Bacterial
MYTLFIRSFYDTNNDGVGDYNGVAQKVDYLKTLGVDTVWFLPFNKAKSYHGYDVEDYYDVEPDYGTYAQLENMIKTLNQNGIRVVMDLVVNHTSDTHSWFLDAVENTTNSKYWSYYIMTLENRDGWNHWHWKINSKGQKVYYFGLFDSSMPDLNFDNPQVMNEIKRIIDFWITVGVDGFRLDAPKHYKGWDWDDGISGSAAIAREIESYIRSKLGNDAIVVGEVYDGNPSVLSQFAPMPAFNFTFMYGITGNHEGKDNLLGETISWVNGASYYLNVKHFPFIDNHDLNRWISILIDQKYSGNTQVGTKQYILTNALLLSLNGMPVIYYGNEIGLRGWKWGQDPWDLPVREPMQWYASQSGAGQTWWTKPVYQQKGITFGNANVDGAMYDDPNDGVSVEEQMNGYTINNFFKQFITLRKTYPALSKGSITIERDWKNLYVIKRVYGNQEVLVLINLDPTWPNNYTLPGGYRWVWYAFFNGSLFEFGNKNESPLSQDTNWTVNPRQVYVFVKD

SEQ ID NO: 101 - DNA, 2136 bp, Unknown
  Obtained from an environmental sample.
ttgcgattctttccaaagttaatatccccttttccgcaaaacaccagagagtggcagcgaagcgcagtatcaagagacactgaacaattacaaaggaaagtaataatgatcaatttgaaaaaaaacaccattagcgccctggtcgcaggtatggtattaggctttgcatccaacgcaatggcggttcctagaaccgcttttgtacacctctttgaatggaaatgggaagatgttgcacaggagtgtgaaacatttctcggacctaaaggctttgccgcagtgcaagtctctccgccaactaaatctcacaacacggatgcatggtggggccgttatcaacccgttagttatgcttttgaaggacgcagcggtaatcgcagccaatttaaaaatatggtgcaacgttgtaaagctgtaggcgtcgatatatacgtagatgcagtgattaaccacatggcagcctacgacagaaatttccctgatgtaccctatagcagtaatgactttaactcctgtacaggagatattgactataataaccgttggcaaacacagcattgtgatttagtcggtcttaatgatctaaaaacaggatctgactacgtccgccaaaaaatagcggattatatgaacgacgcaatcagtatgggtgtagctggtttccgtattgatgcagccaaacatataccagcaggtgatatagctgccattaaaggtaaattaaatggtaatccatacatcttccaagaggtaattggtgcatccggcgaacctgttcgaccgactgaatacacctttatcggtggtgtcacggaatttcaatttgctcgaaaattgggtccagccttccgcaatagtaatattgcttggttaaaagacattggcagtcaaatggaattatccagtgctgatgccgtaacatttgtaacgaatcatgatgaagagcgtcataacccgaatggtcctatttggcacggcgttcaaggtaatggttatgcattagcaaatattttcaccttagcttacccttacggctatccaaaaatcatgtcaggatacttcttccacggtgactttaacgcagctccaccaagcagtggtatacacacaggaaatgcgtgtggttttgatggcggagactgggtatgcgaacacaaatggcgcggtattgctaacatggttgccttccgcaactatacagcaagcgaatggcgtatcagtaattggtggcaaaacagtaacgaccaaattgcttttggtcgcggtggtttaggttttgttgttattaataaacgtgctaatggtagcattaatcaaagttttgatacgggaatgcctgatggccaatactgtaacataatagaagctaactttgatgaaagcaccggccaatgtagtgcagctacagattccaacggtcaagccgttattaccgtcagtggtgggcaagctaactttaatgtagcaggcgatcatgctgctgcaattcatgttggcgcaaaaattggtgatcaatgtagtggtgatgattgcccatgtacaggatccgattgtaataatgatcctaaacctgattttgcagtaccagcaacatcaatttgtacatcagaaaatttacctacgctatattactggggagcacagcctacagatagcttagcgaatgcagcttggccaggtgtcgcaatgcaaacaaatggcgactttaagtgtcatgatttaggtgtcgaactaaccaaaattaacgccatctttagtgacaatggtgcaaataaaacagctgatctaactgttactggtgcaggttgttataaagacgggacttggagcaccttacaaaattgtggctttgaaattaccggtgcacaaaccaatccagtcggtggcgacgaagtctggtacttccgaggtactgctaatgactggggtaaagcacaattagattatgacgcaactagcggtttgtattacacaatacaaagctttaatggtgaagaagcacctgcgcgttttaaaattgataatggtagttggactgaagcttatccaacagctgattaccaagttacagataacaattcataccgcattaactttaatagcgatagcaaagcgattacagtaaacgcacaataa

SEQ ID NO: 102 - protein, 711 aa, Unknown
  Obtained from an environmental sample.
MRFFPKLISPFPQNTREWQRSAVSRDTEQLQRKVIMINLKKNTISALVAGMVLGFASNAMAVPRTAFVHLFEWKWEDVAQECETFLGPKGFAAVQVSPPTKSHNTDAWWGRYQPVSYAFEGRSGNRSQFKNMVQRCKAVGVDIYVDAVINHMAAYDRNFPDVPYSSNDFNSCTGDIDYNNRWQTQHCDLVGLNDLKTGSDYVRQKIADYMNDAISMGVAGFRIDAAKHIPAGDIAAIKGKLNGNPYIFQEVIGASGEPVRPTEYTFIGGVTEFQFARKLGPAFRNSNIAWLKDIGSQMELSSADAVTFVTNHDEERHNPNGPIWHGVQGNGYALANIFTLAYPYGYPKIMSGYFFHGDFNAAPPSSGIHTGNACGFDGGDWVCEHKWRGIANMVAFRNYTASEWRISNWWQNSNDQIAFGRGGLGFVVINKRANGSINQSFDTGMPDGQYCNIIEANFDESTGQCSAATDSNGQAVITVSGGQANFNVAGDHAAAIHVGAKIGDQCSGDDCPCTGSDCNNDPKPDFAVPATSICTSENLPTLYYWGAQPTDSLANAAWPGVAMQTNGDFKCHDLGVELTKINAIFSDNGANKTADLTVTGAGCYKDGTWSTLQNCGFEITGAQTNPVGGDEVWYFRGTANDWGKAQLDYDATSGLYYTIQSFNGEEAPARFKIDNGSWTEAYPTADYQVTDNNSYRINFNSDSKAITVNAQ

SEQ ID NO: 103 - DNA, 1650 bp, Unknown
  Obtained from an environmental sample.
gtgctaacgtttcaccgcatcattcgaaaaggatggatgttcctgctcgcgtttttgctcactgcctcgctgttctgcccaacaggacagcccgccaaggctgccgcaccgtttaacggcaccatgatgcagtattttgaatggtacttgccggatgatggcacgttatggaccaaagtggccaatgaagccaacaacttatccagccttggcatcaccgctctttggctgccgcccgcttacaaaggaacaagccgcagcgacgtagggtacggagtatacgacttgtatgacctcggcgaattcaatcaaaaagggaccgtccgcacaaaatacggaacaaaagctcaatatcttcaagccattcaagccgcccacgccgctggaatgcaagtgtacgccgatgtcgtgttcgaccataaaggcggcgccgacggcacggaatgggtggacgccgtcgaagtcaatccgtccgaccgcaaccaagaaatctcgggcacctatcaaatccaagcatggacgaaatttgattttcccgggcggggcaacacctactccagctttaagtggcgctggtaccattttgacggcgttgattgggacgaaagccgaaaattgagccgcatttacaaattccgcggcatcggcaaagcgtgggattgggaagtagacacggaaaacggaaactatgactacttaatgtatgccgaccttgatatggatcatcccgaagtcgtgaccgagctgaaaaactggggggaatggtatgtcaacacaacgaacattgatgggttccggcttgatgccgtcaagcatattaagttcagtttttttcctgattggttgtcgtatgtgcgttctcagactggcaagccgctatttaccgtcggggaatattggagctatgacatcaacaagttgcacaattacattacgaaaacaaacggaacgatgtctttgtttgatgccccgttacacaacaaattttataccgcttccaaatcagggggcgcatttgatatgcgcacgttaatgaccaatactctcatgaaagatcaaccgacattggccgtcaccttcgttgataatcatgacaccgaacccggccaagcgctgcagtcatgggtcgacccatggttcaaaccgttggcttacgcctttattctaactcggcaggaaggatacccgtgcgtcttttatggtgactattatggcattccacaatataacattccttcgctgaaaagcaaaatcgatccgctcctcatcgcgcgcagggattatgcttacggaacgcaacatgattatcttgatcactccgacatcatcgggtggacaagggaaggggtcactgaaaaaccaggatccgggctggccgcactgatcaccgatgggccgggaggaagcaaatggatgtacgttggcaaacaacacgctggaaaagtgttctatgaccttaccggcaaccggagtgacaccgtcaccatcaacagtgatggatggggggaattcaaagtcaatggcggttcggtttcggtttgggttcctagaaaaacgaccgtttctaccatcgctcggccgatcacaacccgaccgtggactggtgaattcgtccgttggaccgaaccacggttggtggcatggccttga

SEQ ID NO: 104 - protein, 549 aa, Unknown
  Obtained from an environmental sample.
VLTFHRIIRKGWMFLLAFLLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGEWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 105 - DNA, 1650 bp, Unknown
  Obtained from an environmental sample.
atgtccctattcaaaaaaatctttccgtggattgtatctctacttcttttgttttcgtttattgctcctttttccattcaaacagaaaaagtccgcgctggaagtgttccagtgaatggaacgatgatgcaatatttcgaatggtaccttccagacgatggaacactatggacgaaagtagcaaataacgcccaatctttagcgaatcttggcattactgccctttggcttccccctgcctataaaggaacaagcagcagtgacgttggatatggcgtttatgatttatatgacctaggagagtttaatcaaaaaggaactgtccgaacaaaatacggaacaaaaacacaatatatccaagcaatccaagcggcgcatacagcaggaatgcaagtatatgcagatgtcgtctttaaccataaagccggtgcagatgggacagaactagtggatgcagtagaagtaaacccttctgaccgcaatcaagaaatatcaggaacatatcaaatccaagcgtggacaaaatttgattttcctggtcgtggaaacacctattctagttttaaatggcgttggtatcatttcgatggaacggactgggatgagagtagaaaactaaatcgtatttacaaattccgcggcacgggaaaagcatgggattgggaagtagatacagaaaatgggaattatgactatctcatgtatgcagatttggatatggatcatccagaggttgtatctgaactaaaaaattggggaaagtggtatgtaaccacaaccaatatcgacggattccgtctggatgcagtgaagcatattaaatatagctttttcccagactggctatcgtatgtacgaacccaaacacaaaagcctctttttgccgttggcgaattttggagctatgacattaacaagctacacaactatattacaaagacgaacggctctatgtccctattcgatgccccgctgcataacaatttttatatagcatcgaaatcaggtggctattttgatatgcgcacattactcaacaacacattgatgaaagatcaaccaacactatcggtcacattagtagacaatcacgatactgagccagggcaatctttgcagtcgtgggtcgagccgtggtttaaaccgttagcttacgcatttatcttgacccgccaagaaggttatccgtgcatcttttatggagattactatggtattccaaaatacaacattcctgcgctgaaaagcaaacttgatccgctgttaattgctcgaagagattatgcctacggaacacagcacgactatattgacaatgcagatattatcggctggacgcgggaaggagtagctgaaaaagcaaattcgggacttgctgcactcattaccgacggacctggcggaagcaaatggatgtatgttggcaaacaacacgctggcaaaacgttttatgatctaaccggcaatcgaagtgatacagtgacaatcaacgctgatggatggggagaatttaaagtcaatggagggtctgtatccatatgggttccaaaaacatcaaccacttcccaaatcacatttactgtaaataatgccacaaccgtttggggacaaaatgtatacgttgtcgggaatatttcgcagctgggcaac

SEQ ID NO: 106 - protein, 550 aa, Unknown
  Obtained from an environmental sample.
MSLFKKIFPWIVSLLLLFSFIAPFSIQTEKVRAGSVPVNGTMMQYFEWYLPDDGTLWTKVANNAQSLANLGITALWLPPAYKGTSSSDVGYGVYDLYDLGEFNQKGTVRTKYGTKTQYIQAIQAAHTAGMQVYADVVFNHKAGADGTELVDAVEVNPSDRNQEISGTYQIQAWTKFDFPGRGNTYSSFKWRWYHFDGTDWDESRKLNRIYKFRGTGKAWDWEVDTENGNYDYLMYADLDMDHPEVVSELKNWGKWYVTTTNIDGFRLDAVKHIKYSFFPDWLSYVRTQTQKPLFAVGEFWSYDINKLHNYITKTNGSMSLFDAPLHNNFYIASKSGGYFDMRTLLNNTLMKDQPTLSVTLVDNHDTEPGQSLQSWVEPWFKPLAYAFILTRQEGYPCIFYGDYYGIPKYNIPALKSKLDPLLIARRDYAYGTQHDYIDNADIIGWTREGVAEKANSGLAALITDGPGGSKWMYVGKQHAGKTFYDLTGNRSDTVTINADGWGEFKVNGGSVSIWVPKTSTTSQITFTVNNATTVWGQNVYVVGNISQLGN

SEQ ID NO: 107 - DNA, 1509 bp, Unknown
  Obtained from an environmental sample.
atggacagcctcgacgcgccggagcagaagccctgggtgaaggatggcaggctctccgcgtacctggatacagggacagggaccgtggtcgctcccgaggcacctgcgcccccgccgcccccggccgaggaagtccggcccgtggacaagtggaaaaacgatatcatctatttcgtcctcaccgaccgtttccaggatggcgacaagaccaacaacatggacgtggtcccgacggacatgaaaaaatatcatggcggcgacatccaggggctcatcgacaagctcgactatatcaaggagaccggttcgacggccatctggctcacgccccctatgaaggggcagacccacttcttcgagaccgacaattaccatggttactggcccattgacttctatgacacggacccccatgtgggcaccatgcagaaatttgaggagcttatcgagaaagcccatgagaaagggctgaagatcgtgctcgatattcccctgaaccacacggcctgggagcatcccttctacaaggacgacagcaagaaggactggttccaccatataggagatgtgaaggactgggaagatccctactgggctgaaaacggctccatattcggtcttcctgacctggcgcaggaaaaccctgccgtggaaaagtacctcatcgacgtggccaagttctgggtagacaagggtattgacggcttcaggcttgacgccgtgaagaacgtgcccctcaacttctgggcgaagtttgaccgggcgattcacgattatgcgggcaaggacttcctcctcgtcggggaatactttgacggaaacccggcgaaagtcgcgaactaccagagagaggacatgagctcactcttcgattacccgctctactggaccctgaaggacaccttcgccaaggacgggagcatgcgcaacctggcggcgaagcttgatgagtgcgacaggaattatcccgacccgggcctcatgtcggttttccttgataaccacgacacgccgaggttcctcaccgaggccaacggcaacaaggataagctcaaactggccctcgccttcgcgatgaccatcaaccgcatgcctaccatttattatggcaccgaggttgccatggaaggcaactgcgatatcatgggcgccgtagataaccggagggacatgcagtgggacaaggatcctgacatgttcaaatacttcaagactctcaccactgcccgcaatgagcatgaatccctcagggaaggaaagaagctcgagatgtggcaggatgacaaagtctacgcgtacgggaggcagaccccgaaggacgagtctatcgtggtgcttaacaacggctatgatacgcaggaacgggacataccgctccgccccgagagcggcatcaagaacggcacggtgctgaaggatgtcatcaccggcgaaaccgtgacggtacagaacggaaaaatccatgcgaaatgcggcggcaaacaggcgcggatctacgtgcccgcgtag

SEQ ID NO: 108 - protein, 502 aa, Unknown
  Obtained from an environmental sample.
MDSLDAPEQKPWVKDGRLSAYLDTGTGTVVAPEAPAPPPPPAEEVRPVDKWKNDIIYFVLTDRFQDGDKTNNMDVVPTDMKKYHGGDIQGLIDKLDYIKETGSTAIWLTPPMKGQTHFFETDNYHGYWPIDFYDTDPHVGTMQKFEELIEKAHEKGLKIVLDIPLNHTAWEHPFYKDDSKKDWFHHIGDVKDWEDPYWAENGSIFGLPDLAQENPAVEKYLIDVAKFWVDKGIDGFRLDAVKNVPLNFWAKFDRAIHDYAGKDFLLVGEYFDGNPAKVANYQREDMSSLFDYPLYWTLKDTFAKDGSMRNLAAKLDECDRNYPDPGLMSVFLDNHDTPRFLTEANGNKDKLKLALAFAMTINRMPTIYYGTEVAMEGNCDIMGAVDNRRDMQWDKDPDMFKYFKTLTTARNEHESLREGKKLEMWQDDKVYAYGRQTPKDESIVVLNNGYDTQERDIPLRPESGIKNGTVLKDVITGETVTVQNGKIHAKCGGKQARIYVPA

SEQ ID NO: 109 - DNA, 1374 bp, Unknown
  Obtained from an environmental sample.
atggcaagaaaaacgctggccatatttttcgtacttctagtgcttcttagtctctcggcagttccggcaaaggcagaaactctagagaatggtggagttataatgcaggctttctattgggatgttcctggaggaggaatctggtgggacacaatagctcaaaagatacccgaatgggcaagtgcaggaatctcagcgatatggattccaccagcgagtaagggcatgagcggtggttattccatgggctacgatccctacgatttctttgacctcggcgagtactatcagaaggggacagttgagacgcgcttcggctcaaaggaagaactggtgaacatgataaacaccgcacactcctacggcataaaggtgatagcggacatagtcataaaccaccgcgccggtggagaccttgagtggaaccccttcgtgaacgactatacctggacagacttctcaaaagtcgcctccggtaaatatacggccaactaccttgacttccacccaaacgagcttcactgttgtgatgaaggtacctttggaggataccctgatatatgtcacgacaaaagctgggaccagtactggctctgggcgagcagcgaaagctacgctgcctacctcaggagcataggggttgacgcctggcgtttcgactacgtcaagggctacggagcatgggttgttaacgactggctcagctggtggggaggctgggccgttggagagtactgggacacgaacgttgatgcactcctcaactgggcatacagcagcggcgccaaggtctttgacttcccgctctactacaagatggacgaagccttcgacaacaccaacatcccggcattagtggatgcactcagatacggccagacagtggtcagccgcgatcccttcaaggcggtaactttcgttgccaaccacgatacagatataatctggaacaagtatccggcttatgcattcatccttacctatgagggacagcctgttatattctaccgcgactacgaggagtggctcaacaaggataagcttaacaacctcatctggatacacgatcaccttgctggagggagtactgacattgtttactacgacagcgacgagcttatctttgtgagaaacggctatggcaccaaaccaggactgataacctatatcaacctcggctcaagcaaagttggaaggtgggtctacgttccaaagttcgccggttcatgcatccacgagtacaccggcaacctcggcggttggatagacaagtacgtctcctccagcggctgggtctatcttgaggccccagcccacgacccggcgaacggctactacggctactctgtctggagctactgcggtgtgggttga

SEQ ID NO: 110 - protein, 457 aa, Unknown
  Obtained from an environmental sample.
MARKTLAIFFVLLVLLSLSAVPAKAETLENGGVIMQAFYWDVPGGGIWWDTIAQKIPEWASAGISAIWIPPASKGMSGGYSMGYDPYDFFDLGEYYQKGTVETRFGSKEELVNMINTAHSYGIKVIADIVINHRAGGDLEWNPFVNDYTWTDFSKVASGKYTANYLDFHPNELHCCDEGTFGGYPDICHDKSWDQYWLWASSESYAAYLRSIGVDAWRFDYVKGYGAWVVNDWLSWWGGWAVGEYWDTNVDALLNWAYSSGAKVFDFPLYYKMDEAFDNTNIPALVDALRYGQTVVSRDPFKAVTFVANHDTDIIWNKYPAYAFILTYEGQPVIFYRDYEEWLNKDKLNNLIWIHDHLAGGSTDIVYYDSDELIFVRNGYGTKPGLITYINLGSSKVGRWVYVPKFAGSCIHEYTGNLGGWIDKYVSSSGWVYLEAPAHDPANGYYGYSVWSYCGVG

SEQ ID NO: 111 - DNA, 1416 bp, Unknown
  Obtained from an environmental sample.
atgcccgcgttcaaatctaaggtgatgcacatgaagttgaagtaccttgctttagttttgttggctgtggcttcgataggcctcctctcgactccagtgggtgctgccaagtactccgaactcgaagagggcggtgttataatgcaggccttctactgggacgtccctaccggtgggatctggtgggacaccataagacagaaaatcccggagtggtacgacgctggaatctcggcgatatggattcctccagctagcaaaggtatgggtggtgcatactccatgggttatgacccctacgatttctttgacctcggcgagtactatcagaagggaacagttgagacgcgcttcggctcaaaggaggaactggtgaacatgataaacaccgcacactcctatggcataaaggtgatagcggacatagtcataaaccaccgcgccggcggcgacctggagtggaacccctttgtaaacaactatacttggacagacttctccaaggtcgcctccggtaaatacacggccaactaccttgacttccacccaaacgaggtcaagtgctgcgatgagggtacatttggtgactttccggacatcgcccacgagaagagctgggatcagtactggctctgggcaagcaatgagagctacgccgcctatctccggagcatagggatcgatgcatggcgtttcgactacgtcaaaggttacggagcgtgggttgttaacgactggctcagctggtggggaggttgggccgttggagagtactgggacaccaacgttgatgcactccttaactgggcatacaacagcggtgccaaggtctttgacttcccgctctactacaagatggacgaagcctttgacaacaccaacatccccgctttggtttacgccctccagaacggaggaacagtcgtttcccgcgatcccttcaaggcagtaactttcgttgccaaccacgataccgatataatctggaacaagtatccggcttatgcgttcatccttacctatgagggacagcctgttatattctaccgcgactacgaggagtggctcaacaaggataagcttaacaaccttatctggatacacgagcaccttgccggaggaagtaccaagatcctctactacgataacgatgagctaatattcatgagggagggctacgggagcaagccgggcctcataacctacataaacctcggaaacgactgggccgagcgctgggtgaacgtcggctcaaagtttgccggctacacaatccatgaatacacaggcaatctcggtggctgggttgacaggtgggttcagtacgacggatgggttaaactgacggcacctcctcacgatccagccaacggatattacggctactcagtctggagctacgcaggcgtcggatga

SEQ ID NO: 112 - protein, 471 aa, Unknown
  Obtained from an environmental sample.
MPAFKSKVMHMKLKYLALVLLAVASIGLLSTPVGAAKYSELEEGGVIMQAFYWDVPTGGIWWDTIRQKIPEWYDAGISAIWIPPASKGMGGAYSMGYDPYDFFDLGEYYQKGTVETRFGSKEELVNMINTAHSYGIKVIADIVINHRAGGDLEWNPFVNNYTWTDFSKVASGKYTANYLDFHPNEVKCCDEGTFGDFPDIAHEKSWDQYWLWASNESYAAYLRSIGIDAWRFDYVKGYGAWVVNDWLSWWGGWAVGEYWDTNVDALLNWAYNSGAKVFDFPLYYKMDEAFDNTNIPALVYALQNGGTVVSRDPFKAVTFVANHDTDIIWNKYPAYAFILTYEGQPVIFYRDYEEWLNKDKLNNLIWIHEHLAGGSTKILYYDNDELIFMREGYGSKPGLITYINLGNDWAERWVNVGSKFAGYTIHEYTGNLGGWVDRWVQYDGWVKLTAPPHDPANGYYGYSVWSYAGVG

SEQ ID NO: 113 - DNA, 1539 bp, Unknown
  Obtained from an environmental sample.
atgaaacaacaaaaacggctttacgcccgattgctgacgctgttatttgcgctcatcttcttgctgcctcattctgcagcagcggcggcaaatcttaatgggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaagcggttacatttgtcgataaccatgatacacagccggggcaatcgcttgagtcgactgtccaaacatggtttaagccgcttgcttacgctttcattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatag

SEQ ID NO: 114 - protein, 512 aa, Unknown
  Obtained from an environmental sample.
MKQQKRLYARLLTLLFALIFLLPHSAAAAANLNGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHRIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNGTVVSKHPLKAVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 115 - DNA, 1338 bp, Eukaryote
atggcgaagtactccgagctggagcagggcggagtcataatgcaggccttctactgggacgttccggagggaggaatctggtgggacacaatacggcagaagatccctgaatggtacgatgcaggcatatccgccatctggatacccccggcgagcaagggcatgggcggggcctactcgatgggctacgacccctacgattacttcgatctgggcgagttttaccagaagggaaccgttgagacccgcttcggctccaaggaagagctcgtcaacatgatctccacggcccaccagtacggcatcaaggttatagcggacatagtgataaaccaccgcgcaggtggagacctcgaatggaacccatacgtcggcgactatacctggacggacttttctaaggtcgcctccgggaaatacaaggcccactacatggacttccatccaaacaactacagcacctcagacgagggaaccttcggtggcttcccagacattgatcacctcgtgcccttcaaccagtactggctgtgggcgagcaacgagagctacgccgcctacctcaggagcatagggatcgatgcgtggcgctttgactacgttaagggctacggcgcgtgggtcgtcaaggactggctgagtcagtggggcggctgggccgtcggcgagtactgggacaccaacgtcgatgcgctcctcaactgggcctacagcagcggcgccaaggtcttcgacttcccgctctactacaagatggacgaggcctttgacaacaagaacattcccgccctcgtttacgccatccagaacggtgaaaccgtcgtcagcagggatcccttcaaggccgttaccttcgtggctaaccacgatacgaacataatctggaacaagtaccctgcctatgccttcatcctgacctacgaaggtcagcccgtcatcttctaccgcgactacgaggagtggctcaacaaggacaaactcaacaacctcatatggattcacgagcacctggcagggggaagcaccaagatcctctactacgacgacgatgagctcatcttcatgagggaaggctacggcgacaggcccgggcttataacctacatcaacctcggtagcgactgggcggagagatgggtgaacgttggctcaaagttcgcgggctatacaatccacgaatacaccggaaacctcggcggctgggtcgacaggtacgtccagtacgacggctgggtcaagcttaccgctccgccacacgatccggcaaacggctattacggctactcggtctggagctacgccggagttggaagatctcatcaccatcaccatcactaa

SEQ ID NO: 116 - protein, 445 aa, Eukaryote
MAKYSELEQGGVIMQAFYWDVPEGGIWWDTIRQKIPEWYDAGISAIWIPPASKGMGGAYSMGYDPYDYFDLGEFYQKGTVETRFGSKEELVNMISTAHQYGIKVIADIVINHRAGGDLEWNPYVGDYTWTDFSKVASGKYKAHYMDFHPNNYSTSDEGTFGGFPDIDHLVPFNQYWLWASNESYAAYLRSIGIDAWRFDYVKGYGAWVVKDWLSQWGGWAVGEYWDTNVDALLNWAYSSGAKVFDFPLYYKMDEAFDNKNIPALVYAIQNGETVVSRDPFKAVTFVANHDTNIIWNKYPAYAFILTYEGQPVIFYRDYEEWLNKDKLNNLIWIHEHLAGGSTKILYYDDDELIFMREGYGDRPGLITYINLGSDWAERWVNVGSKFAGYTIHEYTGNLGGWVDRYVQYDGWVKLTAPPHDPANGYYGYSVWSYAGVGRSHHHHHH

SEQ ID NO: 117 - DNA, 1476 bp, Unknown
  Obtained from an environmental sample.
atgcgagtgttcctggttgtgccaaagctgagccgcccatttcaggcagagtcacaacaacaagacagggacataacaatgaaacacacagcgggaatgctggcgatcgcaggtatgctgatcgcccccttggcgcatgccgatgtcatactgcacgccttcaactggaaatacagtgaagtcaccgccaaggccgatctcatcaaggctgccggctacaagcaggtgctcatctcaccgcctctgaagtcctcgggcaacgagtggtgggctcgttaccagccccaggatctgcgcctggtcgacaccccccttggcaacaagcaggatctggagcagctgatcgccgcgatgcagacccggggcattgccgtctacgcggacgtggtgctcaaccacatggccaacgaaagctggaagcgcagcgacctcaactaccccggcagcgagctgctgcaaagctacgccggcaatccggcctactttgaacgccagaagctctttggcgatctggggcagaacttcctcgccggccaggattttcatccggaggggtgcatcaccgactggaacaatccgggccatgtccagtactggcgactgtgcggcggggcgggtgacaaggggctgccggatctggaccccaacaactgggtggtgaaccagcaacaggcttacctgcaggcgctcaaggggatggggatcaagggttttcgggtcgatgcggtcaagcacatgagcgattaccagatcaacgccgtgttcacccccgagatcaaacaggggatgcacgtctttggcgaggtgatcaccacggggggcgccggcaacagcgactatgagaacttcctcaaaccctacctcgacagcagcggccagggggcctacgacttcccgctcttcgcctccctgcgtggagcgctgggctacggcggcagcatgaacctgctggccgatcccggtgcctatggtcaggcgctgccgggtagccgcgccgtcaccttcgccatcacccacgacatccccaccaacgacggtttccgctaccagatcctcaaccagaccgacgagagactggcctatgcctacctgctcggtcgcgatggcggttcgcctctggtctactccgatcacggtgaaaccagggacaaggacggattgcgctggcaggactactatctgcgcaccgatctcaaagggatgatccgcttccataacacagtgcagggtcaaccgatgcagctcatcggcagtaacgactgcttcgtgctgttcaagcgtggcaagcagggcgtggtcggcatcaacaagtgcgactacgagcaggagtactggctcgataccgccagattcgagatgaactggtatcgcaactaccgggatgtgctcgaccagaatgccgtggtcaacgtgcagagccagtgggtaaggctgaccatcccggcccgcggcgccagaatgtggctgcaggagtga

SEQ ID NO: 118 - protein, 491 aa, Unknown
  Obtained from an environmental sample.
MRVFLVVPKLSRPFQAESQQQDRDITMKHTAGMLAIAGMLIAPLAHADVILHAFNWKYSEVTAKADLIKAAGYKQVLISPPLKSSGNEWWARYQPQDLRLVDTPLGNKQDLEQLIAAMQTRGIAVYADVVLNHMANESWKRSDLNYPGSELLQSYAGNPAYFERQKLFGDLGQNFLAGQDFHPEGCITDWNNPGHVQYWRLCGGAGDKGLPDLDPNNWVVNQQQAYLQALKGMGIKGFRVDAVKHMSDYQINAVFTPEIKQGMHVFGEVITTGGAGNSDYENFLKPYLDSSGQGAYDFPLFASLRGALGYGGSMNLLADPGAYGQALPGSRAVTFAITHDIPTNDGFRYQILNQTDERLAYAYLLGRDGGSPLVYSDHGETRDKDGLRWQDYYLRTDLKGMIRFHNTVQGQPMQLIGSNDCFVLFKRGKQGVVGINKCDYEQEYWLDTARFEMNWYRNYRDVLDQNAVVNVQSQWVRLTIPARGARMWLQE

SEQ ID NO: 119 - DNA, 1695 bp, Bacterial
atgcaaacgtttgcattcttattttactcaaagaaaggatgggtgtgcatgaattatttgaaaaaagtgtggttgtattacgctatcgtcgctaccttaatcatttcctttcttacacctttttcaacagcacaagctaatactgcacctgttaacggaacaatgatgcaatatttcgaatgggacttacctaatgatgggacgctttggacgaaagtaaaaaatgaagctaccaatctttcttcactaggtatcacagcactatggctccctccagcatataaaggaacgagccaaagcgatgtcggatacggtgtttacgatttatatgaccttggggaatttaatcaaaaagggacgatccgaacgaaatacggaacaaaaacacaatatattcaagccattcaaactgcccaagccgcagggatgcaagtatatgcggatgttgtatttaatcataaggcaggggctgacagtacagaatttgtcgatgcagttgaggtaaacccttctaatcgaaatcaagaaacatctggcacatatcaaattcaagcatggacaaaatttgattttcctggtcgtggaaacacatactccagcttcaaatggcgctggtaccattttgatggtacggattgggacgaaagtcgtaaattaaatcgtatttacaaattccgcggtacaggaaaagcgtgggactgggaagtcgatacagaaaacggaaactatgattatttaatgttcgctgatttagatatggatcaccctgaggttgtgacagaattaaaaaactggggaacgtggtacgtcaatactacaaatatcgatggattccgcttagatgccgtaaaacatattaaatacagctttttccctgactggctaacatatgtacgtaatcaaacaggaaaaaatttatttgccgttggggaattttggagctatgacgtcaataagctgcataattacattacaaaaacaaatgggtcgatgtcattatttgatgcacccttgcataacaacttttataccgcttccaaatcgagtggatattttgacatgcgttatttattgaataatacattaatgaaagatcaaccttcactcgctgtaacacttgtcgataaccacgacacgcaaccagggcaatctttacagtcatgggtcgaaccttggtttaaacagcttgcttacgcctttattttaacaagacaagaagggtatccttgcgtattttacggtgattattatggaatccctaaatacaatatcccggggttaaaaagtaaaatcgacccgcttttaattgctcgtcgtgattacgcttatggaacacaacgtgattacattgatcatcaagacattatcggatggacacgagaaggcattgatgcaaaaccgaactctggactggcggctttaattaccgacggtcctggtggaagtaaatggatgtatgtcggtaaaaagcatgccgggaaagtattttatgatttaactggaaatcgaagtgacacagtaacgattaatgcggatggttggggagaatttaaagtaaacggaggatccgtctcaatttgggtggctaaaacgtcaaacgtcacatttacagtcaataacgccacaacaacaagcggacaaaacgtatatgttgtcggcaacattccagagctaggcaattgtcgcacgggttaa

SEQ ID NO: 120 - protein, 564 aa, Bacterial
MQTFAFLFYSKKGWVCMNYLKKVWLYYAIVATLIISFLTPFSTAQANTAPVNGTMMQYFEWDLPNDGTLWTKVKNEATNLSSLGITALWLPPAYKGTSQSDVGYGVYDLYDLGEFNQKGTIRTKYGTKTQYIQAIQTAQAAGMQVYADVVFNHKAGADSTEFVDAVEVNPSNRNQETSGTYQIQAWTKFDFPGRGNTYSSFKWRWYHFDGTDWDESRKLNRIYKFRGTGKAWDWEVDTENGNYDYLMFADLDMDHPEVVTELKNWGTWYVNTTNIDGFRLDAVKHIKYSFFPDWLTYVRNQTGKNLFAVGEFWSYDVNKLHNYITKTNGSMSLFDAPLHNNFYTASKSSGYFDMRYLLNNTLMKDQPSLAVTLVDNHDTQPGQSLQSWVEPWFKQLAYAFILTRQEGYPCVFYGDYYGIPKYNIPGLKSKIDPLLIARRDYAYGTQRDYIDHQDIIGWTREGIDAKPNSGLAALITDGPGGSKWMYVGKKHAGKVFYDLTGNRSDTVTINADGWGEFKVNGGSVSIWVAKTSNVTFTVNNATTTSGQNVYVVGNIPELGNCRTG

SEQ ID NO: 121 - DNA, 1556 bp, Unknown
  Obtained from an environmental sample.
atgctcgccctgtcgctcggcggctgcggcatcgacgcgggcccgacaggccctcgcgtcgtggagccgctgccgcagcgccccacgcttccgcaggagtaccgcgccagcggccacgcggccgccggcgacgtgttcgtgcacctgttcgagtggaagtggccggacatcgcggaggaatgcgagaacgtgctggggccggcgggctacgaggcggtgcaggtgtcgccgccgcaggagcacctggtgcagcagggggcgccgtggtggcagcggtaccagccggtgagctactcggtggcgctgagccgcagcggcacgggcgtggagttcagcaacatgatcagccggtgcaaggccgccggcgtggacatctacgtggacgccgtcatcaaccacatgacggccggtgcggggacggggagcaacggcaccgcctacaccaagtacaactaccccggcctgtacgcgcaggcggactttcacccgcagtgcgcggtgggcgactacaccagcgccgccaacgtgcaggactgcgaactgctggggctggctgacctgaacaccggcgcggccggcgtgcagcagaagatcgcggactacctggtctcgctggcgcggctgggcgtggcgggttttcgcatcgacgccgccaagcacatccagccggtggaactggacgccatcgtggaccgcgtgaaccagacgctggcggcggaggggcgcccgcttccctactggttcgccgaggtgatcgacaacggcggcgagggggtgcggcgcgagcactactacggcctgggatacggcaccggcggcgccgcggacatcacggagttccgctacaagggcgtgggcgacaagttcctgggcagcggcggccagcggctggtggacctgaagaacttctcggcggtgacgtggaacctgatgccgtcggacaaggccgtcgtctttctggagaaccacgatacgcagcgcggcggcggcatcggctaccgcgatggcacggcgttccggctggccaacgtgtggatgctggcgcagccgtacggctatccgtcggtgatgtccagctacgcctttgaccgcacctccccctttggccgcgacgccggcccgccctccgaggacggcgcgacgaaggacgtgacgtgcgcgcccacgctggagacggcggtgctgggcacctgggtgtgcgagcaccgcgaccccgtcattcagcggatggtgggctttcgccgcgcgatggcgggcacggacctgaaccgctggtgggacaacggcggcaacgccattgccttttcgcgcggggaccggggcttcgtcgccatcagccgcgagccgaaggtgaccatggcggccgtgcccagcggactgtcccccggcacctactgcgacgtgctgaccggcggcaaggtgggcaacgcctgcgcgggaaccagcgtgacggtcgactctcagggcgtggtgcagctgagcatcgtcgagaactcggctctggtgatccacctcggggccaagctgtaacggcgcgctggcggatgtgcggaggg

SEQ ID NO: 122 - protein, 517 aa, Unknown
  Obtained from an environmental sample.
MLALSLGGCGIDAGPTGPRVVEPLPQRPTLPQEYRASGHAAAGDVFVHLFEWKWPDIAEECENVLGPAGYEAVQVSPPQEHLVQQGAPWWQRYQPVSYSVALSRSGTGVEFSNMISRCKAAGVDIYVDAVINHMTAGAGTGSNGTAYTKYNYPGLYAQADFHPQCAVGDYTSAANVQDCELLGLADLNTGAAGVQQKIADYLVSLARLGVAGFRIDAAKHIQPVELDAIVDRVNQTLAAEGRPLPYWFAEVIDNGGEGVRREHYYGLGYGTGGAADITEFRYKGVGDKFLGSGGQRLVDLKNFSAVTWNLMPSDKAVVFLENHDTQRGGGIGYRDGTAFRLANVWMLAQPYGYPSVMSSYAFDRTSPFGRDAGPPSEDGATKDVTCAPTLETAVLGTWVCEHRDPVIQRMVGFRRAMAGTDLNRWWDNGGNAIAFSRGDRGFVAISREPKVTMAAVPSGLSPGTYCDVLTGGKVGNACAGTSVTVDSQGVVQLSIVENSALVIHLGAKLRRAGGCAE

SEQ ID NO: 123 - DNA, 1770 bp, Unknown
  Obtained from an environmental sample.
atgccccaggccattcgcactttttcacgttggacgttgttcggcttaatcggcgtttttctgcttggtctcgtcttttctgtcccaccccgggcaatccaggcccagacaaccccggcccgtaccgttatggttcacctcttcgagtggaaatggaccgacatcgctaaagaatgcgagaatttcctcggaccgaaaggctttgccgcaatccaggtatcgccgccccaggagcatgtccaggggtcgcaatggtggacccgctatcagccggtcagctacaagatcgagagccgctccggcacccgggccgagttcgccaatatggtctcgcgctgcaaagccgtcggggtcgatatctatgtcgatgccgtgatcaaccatatgacgactgtcggctccggcactggtatggctggatcgacctacaccagctacacctatccggggctgtatcagacccaggacttccaccactgcgggcgcaatggcaacgatgatatcagcagctacggcgatcgctgggaagtacaaaactgcgaactgctcaacctagccgacctcaacaccggcgctgagtatgtccggggtaaactcgccgcctatatgaacgatctgcgcggcctgggcgtcgccggatttcggatcgatgccgccaagcacatggataccaacgacatcaacaatatcgttggccgcctgcccaacgcgccctacatctaccaggaagtgatcgaccagggcggcgagccaattaccgccggcgaatacttccagaatggcgatgtgaccgagttcaagtacagccgcgagatctcgcgcatgttcaaaaccggccagctgacccatatgagccagttcggcactgcctggggcttcatgtccagcgacctggcagtagttttcaccgataaccacgacaaccagcgcggtcacggcggcgccggcgatgtcttgacctacaaagatggccagctgtacaccctgggcaatatcttcgagctagcctggccgtatggctacccacaggtcatgtcgagctacacgttcagcaacggcgaccaggggccgccatcgaccaatgtgtacgcaaccacaacgcctgattgtggcaacggccgctgggtctgtgagcaccgctggcgaggaatcgccaacatggtcgcgttccgcaactacaccgccccgaccttcagcaccagcaactggtggagcaacggcaacaaccagatcgctttcagccgcgggaccctgggctttgtggcgatcaatcgggaaggtggcagcctgaaccgcaccttccaaaccggcctgcccgtcggcacctactgcgatgtcattcacggcgatttcaatgccagcgccggcacctgttccggcccaactatcgctgtcaacggctccggacaggcaaccatcacggtcaacgcgatggacgcggtggcgatctacggcggagccaggctcgccactccggccagtgtcaacgtgacattcaacgaaaacgccacgaccacctgggggcagaatgtgtatatcgtcggcaacgtcgccgccctgggcagctggaacgcaggcagcgcggtcttactctcctccgctaactacccaatctggagcaagaccatcgccctgccagccaacaccgccattgagtacaagtacatcaaaaaggatggcgcgggcaatgtggtgtgggaaagcggcgccaaccgcgtctttaccacccccggcagcggcagtgccacgcgcaacgatacctggaaatag

SEQ ID NO: 124 - protein, 589 aa, Unknown
  Obtained from an environmental sample.
MPQAIRTFSRWTLFGLIGVFLLGLVFSVPPRAIQAQTTPARTVMVHLFEWKWTDIAKECENFLGPKGFAAIQVSPPQEHVQGSQWWTRYQPVSYKIESRSGTRAEFANMVSRCKAVGVDIYVDAVINHMTTVGSGTGMAGSTYTSYTYPGLYQTQDFHHCGRNGNDDISSYGDRWEVQNCELLNLADLNTGAEYVRGKLAAYMNDLRGLGVAGFRIDAAKHMDTNDINNIVGRLPNAPYIYQEVIDQGGEPITAGEYFQNGDVTEFKYSREISRMFKTGQLTHMSQFGTAWGFMSSDLAVVFTDNHDNQRGHGGAGDVLTYKDGQLYTLGNIFELAWPYGYPQVMSSYTFSNGDQGPPSTNVYATTTPDCGNGRWVCEHRWRGIANMVAFRNYTAPTFSTSNWWSNGNNQIAFSRGTLGFVAINREGGSLNRTFQTGLPVGTYCDVIHGDFNASAGTCSGPTIAVNGSGQATITVNAMDAVAIYGGARLATPASVNVTFNENATTTWGQNVYIVGNVAALGSWNAGSAVLLSSANYPIWSKTIALPANTAIEYKYIKKDGAGNVVWESGANRVFTTPGSGSATRNDTWK

SEQ ID NO: 125 - DNA, 1395 bp, Unknown
  Obtained from an environmental sample.
gtggtgcacatgaagttgaagtaccttgccttagttttgttggctgtggcttcgataggcctactctcgactccagtgggtgctgccaagtactccgaactcgaagagggcggtgttataatgcaggccttctactgggatgttcccggagggggaatctggtgggacaccataagacagaaaatcccggagtggtacgacgctggaatctcggcgatatggattcctccagctagcaaagggatgggcggtggttattccatgggctacgatccctacgatttctttgacctcggcgagtactatcagaagggaacagttgagacgcgcttcggctcaaaggaggaactggtgaacatgataaacaccgcacactcctatggcataaaggtgatagcggacatagtcataaaccaccgcgccggtggagaccttgagtggaacccctttgtaaacaactatacttggacagacttctccaaggtcgcctccggtaaatacacggccaactaccttgacttccacccaaacgaggtcaagtgctgcgatgagggtacatttggtgactttccggacatcgcccacgagaagagctgggatcagtactggctctgggcaagcaatgagagctacgccgcatatctccggagcatagggatcgatgcatggcgtttcgactacgtcaaaggttacggagcgtgggttgttaatgactggctcagctggtggggaggctgggccgttggagagtactgggacacgaacgttgatgcactccttaactgggcatacgacagcggtgccaaggtctttgacttcccgctctactacaagatggacgaagcctttgacaacaccaacatccccgctttggtttacgccctccagaacggaggaacagtcgtttcccgcgatcccttcaaggcagtaactttcgttgccaaccacgatacagatataatctggaacaagtatccggcttatgcgttcatccttacctatgagggacagcctgttatattttaccgcgactacgaggagtggctcaacaaggataagcttaacaaccttatctggatacacgagcaccttgccggaggaagtaccaagatcctctactacgataacgatgagctaatattcatgagggagggctacgggagcaagccgggcctcataacctacataaacctcggaaacgactgggccgagcgctgggtgaacgtcggctcaaagtttgccggctacacaatccatgaatacacaggcaatctcggtggctgggttgacaggtgggttcagtacgatggatgggttaaactgacggcacctcctcatgatccagccaacggatattacggctactcagtctggagctacgcaggcgtcggatga

SEQ ID NO: 126 - protein, 464 aa, Unknown
  Obtained from an environmental sample.
VVHMKLKYLALVLLAVASIGLLSTPVGAAKYSELEEGGVIMQAFYWDVPGGGIWWDTIRQKIPEWYDAGISAIWIPPASKGMGGGYSMGYDPYDFFDLGEYYQKGTVETRFGSKEELVNMINTAHSYGIKVIADIVINHRAGGDLEWNPFVNNYTWTDFSKVASGKYTANYLDFHPNEVKCCDEGTFGDFPDIAHEKSWDQYWLWASNESYAAYLRSIGIDAWRFDYVKGYGAWVVNDWLSWWGGWAVGEYWDTNVDALLNWAYDSGAKVFDFPLYYKMDEAFDNTNIPALVYALQNGGTVVSRDPFKAVTFVANHDTDIIWNKYPAYAFILTYEGQPVIFYRDYEEWLNKDKLNNLIWIHEHLAGGSTKILYYDNDELIFMREGYGSKPGLITYINLGNDWAERWVNVGSKFAGYTIHEYTGNLGGWVDRWVQYDGWVKLTAPPHDPANGYYGYSVWSYAGVG

SEQ ID NO: 127 - DNA, 1848 bp, Unknown
  Obtained from an environmental sample.
gtgtgcatgaattatttgaaaaaagtgtggttgtattacgctatcgtcgctaccttaatcatttactttcttacgcccttttcaactgcacaagccaacactgcaccagtcaacggaacgatgatgcaatatttcgaatgggatttaccgaatgatggcacactttggacgaaagtaaaaaacgaagcaagcagtctttcttctttaggtattactgcgttatggttaccacctgcatacaaaggaacgagccaaggggatgtcgggtatggcgtgtacgatttgtatgacttaggagaatttaatcaaaaagggacgattcgaacgaaatacggaacaaaaacgcaatatttacaagccattcaagcggcaaaaagcgctggcatgcaagtatacgctgatgtcgtatttaatcacaaggcgggggcagatagtacagaatgggttgacgcagtcgaagtgaatccttctaatcgaaaccaagaaacatctggcacatatcaaattcaagcatggacaaaatttgatttccctggccgtgggaacacatactcaagctttaaatggcgatggtatcattttgacggtacggattgggatgaaagccgaaaactaaatcgtatttacaaatttcgtggcacaggaaaagcatgggattgggaagtagacacagagaacggaaactatgactacttaatgtttgctgatttagatatggatcaccctgaagtcgtgacagagctaaaaaactggggaacatggtacgtcaatacgacaaatgtcgatgggtttcgcttagatgcagtaaagcatattaaatatagcttcttcccagattggttaacacatgtgcgttcacaaacacgaaaaaatctttttgcagtaggagaattttggagctacgatgtcaataaactgcataactacattacaaaaacaagtggaaccatgtcgttatttgatgcgccacttcataacaacttttacactgcttcaaaatctagcgggtattttgacatgcgctatttgttaaataatacgttgatgaaagaccagccttctcttgcggtcacactcgttgataatcatgacacgcaaccgggacaatctttacaatcatgggtagagccttggtttaagccgcttgcttatgcctttattttgacaagacaagaaggatatccttgcgtattttacggcgactattacggcatccctaaatacaacattccgggattgaaaagtaaaatcgatccgcttctcattgcccgtagagactacgcatacggaacacaacgtgattatattgaccatcaagacattattggatggacacgggaaggaattgactcaaaaccgaactctggacttgcggctttaattactgacggccctggtggaagtaaatggatgtatgtaggtaaaaagcatgctggaaaagtgttttacgatctcactggaaatcgaagcgatacggtaacgattaatgcagacggctggggagagtttaaagtaaacggtggctccgtttccatttgggttgccaaaacatcacaagtcacgtttaccgtcaacaatgcgacaacgataagcggacaaaatgtgtatgtcgttggtaacattccagagctcggaaattggaacacagcaaacgcaatcaaaatgaccccatcttcttatccaacgtggaaagcaaccattgctcttccacaaggaaaagccattgaatttaaatttattaaaaaagaccaatcgggaaatgttgtttgggaaagcattccaaaccgaacatacaccgttccatttttatcaacaggctcatatacagctagttggaatgtaccttaa

SEQ ID NO: 128 - protein, 615 aa, Unknown
  Obtained from an environmental sample.
VCMNYLKKVWLYYAIVATLIIYFLTPFSTAQANTAPVNGTMMQYFEWDLPNDGTLWTKVKNEASSLSSLGITALWLPPAYKGTSQGDVGYGVYDLYDLGEFNQKGTIRTKYGTKTQYLQAIQAAKSAGMQVYADVVFNHKAGADSTEWVDAVEVNPSNRNQETSGTYQIQAWTKFDFPGRGNTYSSFKWRWYHFDGTDWDESRKLNRIYKFRGTGKAWDWEVDTENGNYDYLMFADLDMDHPEVVTELKNWGTWYVNTTNVDGFRLDAVKHIKYSFFPDWLTHVRSQTRKNLFAVGEFWSYDVNKLHNYITKTSGTMSLFDAPLHNNFYTASKSSGYFDMRYLLNNTLMKDQPSLAVTLVDNHDTQPGQSLQSWVEPWFKPLAYAFILTRQEGYPCVFYGDYYGIPKYNIPGLKSKIDPLLIARRDYAYGTQRDYIDHQDIIGWTREGIDSKPNSGLAALITDGPGGSKWMYVGKKHAGKVFYDLTGNRSDTVTINADGWGEFKVNGGSVSIWVAKTSQVTFTVNNATTISGQNVYVVGNIPELGNWNTANAIKMTPSSYPTWKATIALPQGKAIEFKFIKKDQSGNVVWESIPNRTYTVPFLSTGSYTASWNVP

SEQ ID NO: 129 - DNA, 1854 bp, Unknown
  Obtained from an environmental sample.
atgcgttgccgccgtggcagggacgggtgttggtgcgggcggcgtaatgcgctgccgcgacacccgcgtgaacaaaataatatgaattatttgaataggatgggggtgtcaagaatgacaaaatctcgagagttgcggtgttcatggaaagtatttgttgttgggtgcctgttgtggatggcttggggatcttccgcgtccgccggcgtattgatgcaaggcttctactgggacgccagtaccgggaccagtgattcgtggtggacgcatttggccaagcaagccaacggtctaaaacgggcggggttcaccgccgtatggattcctccggtgcttaaaggggcttcagggggctattccaacgggtacgatccctttgacgactatgatatcggaagcaaggaccagaaaggtaccgtggcgacgcgatgggggacgcgagaagaactgcaacgtgccgtggccgtgatgcgcgcgaacggtctggatgtgtatgtggatctggtgctgaaccaccgcaacggggacgacgggaattggaattttcattacaaagatgcgtacggcaaagtgggttacgggcggtttcaaaaggggttttacgattttcaccccaactacaacattcaggatgccaatgttcccaacgaggattccagcttcgggcgcgatttagcccatgacaatccgtatgtggccgatggactgaaggctgcaggcgattggctgaccaaagccctcgatgttcagggatatcgtctggattacgtgaaaggcatcagctacaccttcctgaaaagttatctgtcctatggggccatgaacggaaaatttgccgtcggtgagtactgggatgccaaccgggatacgttgaactggtgggcgaacacggcgatggaagggcgggcccatgtgtttgattttgcgttgcgcgaggagctgaaaaacatgtgcaatgcggacgggtactacgacatgcgtcgattggaccacgcgggtctggtcggaatcgacccgtggaaggcggtgacgtttgtcgaaaaccatgatacggatcggcacgaccccatctacaataacaagcatttggcgtatgcctacatcttgacgtcggaagggtatccgacggtgttctggaaggattactaccaatacggaatgaagccgatcatcgacaacctcatttggatccacgaacacattgcgtacggaacgacccaagagcgttggaaagacgaagatgtctttgtgtatgagcggaccggaggcaagcggctattggtggggcttaacgacaatcgcgccaccagcaaaacggtcaccgtacagaccggctttggtgccaacgtggccttgcacgactacaccggcaacggccccgatctccgtaccgacgcctacggtcgggtaaccttgaccattcctgcaaacgggtacgtggcctattccgttccgggcatctccggatcctttgtgccggtcgagaaaaccgtgacgcaggagtttgccggggcgtccgacttggatattcgtccggccgataacacgcaatttgtgcaggtcgggcggatatacgccaaggcaaacaagccggttacagcggaattgtattgggatgccaaagactggacgacctccacgtcgattctcctagaagtgcgttcggcttcgggaacgctcatcacgacaaagaccgtgacccaattgtcgtcccagggtacccgcgtttccttcacgccttcggctaccggatggtacgtcttttccattcgaagctataacacgccttcgacgaacccaaagccggcctactggttaaaggtaacgtatacggcgccgcaattgcttcagtaa

SEQ ID NO: 130 - protein, 617 aa, Unknown
  Obtained from an environmental sample.
MRCRRGRDGCWCGRRNALPRHPREQNNMNYLNRMGVSRMTKSRELRCSWKVFVVGCLLWMAWGSSASAGVLMQGFYWDASTGTSDSWWTHLAKQANGLKRAGFTAVWIPPVLKGASGGYSNGYDPFDDYDIGSKDQKGTVATRWGTREELQRAVAVMRANGLDVYVDLVLNHRNGDDGNWNFHYKDAYGKVGYGRFQKGFYDFHPNYNIQDANVPNEDSSFGRDLAHDNPYVADGLKAAGDWLTKALDVQGYRLDYVKGISYTFLKSYLSYGAMNGKFAVGEYWDANRDTLNWWANTAMEGRAHVFDFALREELKNMCNADGYYDMRRLDHAGLVGIDPWKAVTFVENHDTDRHDPIYNNKHLAYAYILTSEGYPTVFWKDYYQYGMKPIIDNLIWIHEHIAYGTTQERWKDEDVFVYERTGGKRLLVGLNDNRATSKTVTVQTGFGANVALHDYTGNGPDLRTDAYGRVTLTIPANGYVAYSVPGISGSFVPVEKTVTQEFAGASDLDIRPADNTQFVQVGRIYAKANKPVTAELYWDAKDWTTSTSILLEVRSASGTLITTKTVTQLSSQGTRVSFTPSATGWYVFSIRSYNTPSTNPKPAYWLKVTYTAPQLLQ

SEQ ID NO: 131 - DNA, 1881 bp, Unknown
  Obtained from an environmental sample.
atgccgcagctttacccattgccgccgcgctggcggcgcgcggcccggcagggcctggccgccttgacgctggccaccacggccctgggcatctcgacggcccaggcccagagtgcaccgcgcacggccttcgtgcatctgttcgaatggaagtggaccgacatcgcgcgcgagtgcgagaccttcctcgggcccaagggcttcgcggcggtgcaggtgtcgcccccgaacgagcacaactgggtgaccagcggtgatggtgcaccttatccgtggtggatgcgctaccagccggtgagctacagcctggaccgcagccgcagcggcacgcgcgccgagttccaggacatggtcaaccgatgcaatgccgtgggcgtgggcatctacgtggacgccgtgatcaatcacatgtccggcggcacgggcggcacctcgagcgctgggcgcagctggagctatcacaactaccctgggctctatggccccaacgacttccaccagccggtgtgcagcatcaccaactacggggatgcgaacaatgtgcagcgttgcgagctctcgggcttgcaggacctggacactgggagcgcttatgtgcgcggcaagatcgccgactatctggtggatctggtcaacatgggggtcaagggcttccgggtggatgcggccaagcacatcagcccgaccgacctgggcgccatcatcgatgcggtcaacagccgcaccggcgcgaaccgccctttctggtttctggaggtgattggcgcggccggcgaggcagtgcagccgaaccagtacttctcgctcggcggcggccaggtcaccgtgaccgagttcaactatgggaagcaaatcttcggcaagttcgccggtggcggccgtctggccgagctgcgcagcttcggtgaaacctggggcctgatgcccagcagcaaagcgattgctttcatcgacaaccacgacaagcagcgcggtcatggcggcggtggcaactatctgacctaccaccatggctcgacctacgatctggccaacatcttcatgctggcttggccttatggctacccggcgctgatgtccagctatgccttcaaccgcagcacggcctacgacacgagctttggcccgccacacgacagtggtggcgccacccgtggcccctgggatggtggcggcagccagccggcctgcttcaaccagagcatcggtggctgggtgtgtgagcaccgctggcggggcatcgccaatatggtggccttccgcaacgccacgctgcccaactggaccgtgaccgactggtgggacaacggcaacaaccagatcgctttcgggcggggtgacaagggcttcgtggtgatcaaccgcgaagacgccgcgctgacgcgcaacttcaagaccagcctgccagccggccagtactgcgatgtcatctccggggacttcaacaatggtcagtgcacgggccatgtggtgacggtcgatgccggcggctacgtgacgctgacggccgggcccaatggtgcggcggccatccacgtgggcgcccgtctggacggcgcctctcagccgccgacgaccgcctcggtgacgttcaacgcgtcggccgataccttttggggacagaacctgttcgtcgtgggcaaccacagcgcactgggcaactggtcgccggcggccgccaggccgatgacttggatttccggttcgggcacgcgcgggaactggcgcgcggtgctcaatttgccggccaataccacctaccaatacaagttcatcaagaaggacggggctggaaacgtggtttgggagggcggtggcaatcgcgtcgtgaccacgccgtctgggggcggatcggtgagcacgggcggcaattggcagtag

SEQ ID NO: 132 - protein, 626 aa, Unknown
  Obtained from an environmental sample.
MPQLYPLPPRWRRAARQGLAALTLATTALGISTAQAQSAPRTAFVHLFEWKWTDIARECETFLGPKGFAAVQVSPPNEHNWVTSGDGAPYPWWMRYQPVSYSLDRSRSGTRAEFQDMVNRCNAVGVGIYVDAVINHMSGGTGGTSSAGRSWSYHNYPGLYGPNDFHQPVCSITNYGDANNVQRCELSGLQDLDTGSAYVRGKIADYLVDLVNMGVKGFRVDAAKHISPTDLGAIIDAVNSRTGANRPFWFLEVIGAAGEAVQPNQYFSLGGGQVTVTEFNYGKQIFGKFAGGGRLAELRSFGETWGLMPSSKAIAFIDNHDKQRGHGGGGNYLTYHHGSTYDLANIFMLAWPYGYPALMSSYAFNRSTAYDTSFGPPHDSGGATRGPWDGGGSQPACFNQSIGGWVCEHRWRGIANMVAFRNATLPNWTVTDWWDNGNNQIAFGRGDKGFVVINREDAALTRNFKTSLPAGQYCDVISGDFNNGQCTGHVVTVDAGGYVTLTAGPNGAAAIHVGARLDGASQPPTTASVTFNASADTFWGQNLFVVGNHSALGNWSPAAARPMTWISGSGTRGNWRAVLNLPANTTYQYKFIKKDGAGNVVWEGGGNRVVTTPSGGGSVSTGGNWQ

SEQ ID NO: 133 - DNA, 1638 bp, Unknown
  Obtained from an environmental sample.
atgaataatgtgaaaaaagtatggttgtattattctataattgctaccttagttatttcctttttcacacctttttcaacagcacaagctaatactgcacctgtcaacggaacaatgatgcaatatttcgaatgggatttaccgaatgatgggacgctttggacgaaagtaaaaaatgaagctaccaatctttcttcgctaggtattacagcgttatggctccctccagcatataaaggaacgagccaaagcgatgtcggatatggcgtgtacgatttatatgaccttggggaatttaatcaaaaagggacgatccgaacgaaatacggaacaaaagcacaatatattcaagccatccaagctgccaaagccgcagggatgcaagtatatgcagatgttgtatttaatcataaggcgggggctgacggcacagaatttgtcgatgcagttgaggtaaacccttctaatcgaaatcaagaaacatctggcacatatcaaattcaagcatggacaaaatttgattttcctggtcgtggaaacacatactccagcttcaaatggcgctggtatcattttgacggtaccgattgggatgaaagtcgtaaattaaatcgtatttacaaattccgcggtacaggaaaagcgtgggactgggaagtcgatacagaaaacggaaactatgattatttaatgttcgctgatttagatatggatcaccctgaagttgtgacagagttaaaaaactggggaaaatggtatgtaaatacgacaaatgtagacggatttcgtttggatgccgtaaaacatattaaatacagctttttccctgactggctaacatatgtacgtaatcaaacaggaaaaaatttatttgctgttggggaattttggagctatgacgtcaataagctgcataactacattacaaaaacaaatggatcgatgtcgttatttgatgcacctttgcataacaacttttatatcgcttccaaatcgagtggatattttgacatgcgttatttattgaataatacattaatgaaagatcaaccttcactcgctgtaacacttgtcgataaccatgatacacaaccaggtcaatctttacaatcatgggtagaagcttggtttaaaccgcttgcttacgcctttattttaacaagacaagaggggtatccttgcgtattttacggtgactattacggaatcccgaaatacaatattccgggattaaaaagtaaaattgatccgcttttaattgctcgtcgtgattatgcttatggaacacaacgtgattacattgatcatcaagacattatcggatggacacgagaaggcattgatgcaaaaccgaactctggacttgcggctttaattaccgacggccctggcggaagtaaatggatgtatgtcggtaaaaaacatgctgggaaagtgttttatgatttaactggaaatcgaagtgacacagtaacgattaatgcggacggttggggagaatttaaagtaaacggcggctccgtttcgatttgggtggctaaaacatcaaacgtcacatttacagtcaataacgccacaacaacaagtggacaaaacgtatatgttgttggcaacattccagagctaggcaattctttg

SEQ ID NO: 134 - protein, 546 aa, Unknown
  Obtained from an environmental sample.
MNNVKKVWLYYSIIATLVISFFTPFSTAQANTAPVNGTMMQYFEWDLPNDGTLWTKVKNEATNLSSLGITALWLPPAYKGTSQSDVGYGVYDLYDLGEFNQKGTIRTKYGTKAQYIQAIQAAKAAGMQVYADVVFNHKAGADGTEFVDAVEVNPSNRNQETSGTYQIQAWTKFDFPGRGNTYSSFKWRWYHFDGTDWDESRKLNRIYKFRGTGKAWDWEVDTENGNYDYLMFADLDMDHPEVVTELKNWGKWYVNTTNVDGFRLDAVKHIKYSFFPDWLTYVRNQTGKNLFAVGEFWSYDVNKLHNYITKTNGSMSLFDAPLHNNFYIASKSSGYFDMRYLLNNTLMKDQPSLAVTLVDNHDTQPGQSLQSWVEAWFKPLAYAFILTRQEGYPCVFYGDYYGIPKYNIPGLKSKIDPLLIARRDYAYGTQRDYIDHQDIIGWTREGIDAKPNSGLAALITDGPGGSKWMYVGKKHAGKVFYDLTGNRSDTVTINADGWGEFKVNGGSVSIWVAKTSNVTFTVNNATTTSGQNVYVVGNIPELGNSL

SEQ ID NO: 135 - DNA, 1935 bp, Unknown
  Obtained from an environmental sample.
gtgacaggcaccccgtctttatacattcctccacataaaataaccatacagctttcaaatttgttgaaatgtataaaaataaaaaatagtattgtaagcgttaacatccgtcattataataacttcaaacgcgtttatgttttaatgcaaacgtttgcatcctcattttatttaaagaaaggatgtgtgtgcatgaattatttgaaaaaagtgtggttgtattacgctatcgtcgctaccttaatcatttcctttcttacgcccttttcaactgcacaagccaacactgcaccagtcaacggaacgatgatgcaatatttcgaatgggatttaccgaatgatggcacactttggacgaaagtaaaaaacgaagcaagcagcctttcttctttaggtattactgcgttatggttaccacctgcatacaaaggaacgagccaaggggatgtcgggtatggcgtgtacgatttgtatgacttaggagaatttaatcaaaaagggacgattcgaacgaaatacggaacaaaaacgcaatatttacaagccattcaagcggcaaaaagcgctggcatgcaagtatacgctgatgtcgtatttaatcacaaggcgggggcagatagtacagaatgggttgacgcagtcgaagtgaatccttctaatcgaaaccaagaaacatctggcacatatcaaattcaagcatggacaaaatttgatttccctgaccgtgggaacacatactcaagctttaaatggcgctggtatcattttgacggtacggattgggatgaaagtcgaaaactaaatcgcatttacaaatttcgtggcacaggaaaagcatgggattgggaagtagacacagagaacggaaactatgactacttaatgtttgctgatttagatatggatcaccctgaagtcgtgacagagctaaaaaactggggaacatggtacgtcaatacgacaaatgtcgatgggtttcgcttagatgcagtaaagcatattaaatatagctttttcccagattggttaacatatgtgcgctcacaaacacaaaaaaatctgtttgcagtaggagaattttggagctacgatgtcaataaactgcataactacattacaaaaacaagtggaaccatgtcgttatttgatgcgccacttcataacaacttttacactgcttcaaaatctagcgggtattttgacatgcgctatttgttaaataatacgttgatgaaagaccagccttctcttgcggtcacactcgttgataatcatgacacgcaaccgggacaatctttacaatcatgggtagagccttggtttaagccgcttgcttatgcctttattttgacaagacaagaaggatatccttgcgtattttacggcgactattacggcatccctaaatacaatattccgggattgaaaagtaaaatcgatccgcttctcattgcccgtagagactacgcatacggaacacaacgtgattatattgaccatcaagacattattggatggacacgggaaggaattgactcaaaaccgaactctggacttgcggctttaattactgacggtcctggtggaagtaaatggatgtatgtaggtaaaaagcatgctggaaaagtgttttacgatctcactggaaatcgaagcgatacggtaacgattaatgcagacggctggggagagtttaaagtaaacggtggctccgtttccatttgggttgccaaaacatcacaagtcacgtttaccgtcaacaatgcgacaacgacaagcggacaaaatgtgtatgtcgttggcaacattccagagctcggaaattggaacacagcaaacgcaatcaaaatgaccccatcttcttatccaacgtggaaaacaaccattgctcttccacaaggaaaagcaattggcggcgtacgccatggcccttga

SEQ ID NO: 136 - protein, 644 aa, Unknown
  Obtained from an environmental sample.
VTGTPSLYIPPHKITIQLSNLLKCIKIKNSIVSVNIRHYNNFKRVYVLMQTFASSFYLKKGCVCMNYLKKVWLYYAIVATLIISFLTPFSTAQANTAPVNGTMMQYFEWDLPNDGTLWTKVKNEASSLSSLGITALWLPPAYKGTSQGDVGYGVYDLYDLGEFNQKGTIRTKYGTKTQYLQAIQAAKSAGMQVYADVVFNHKAGADSTEWVDAVEVNPSNRNQETSGTYQIQAWTKFDFPDRGNTYSSFKWRWYHFDGTDWDESRKLNRIYKFRGTGKAWDWEVDTENGNYDYLMFADLDMDHPEVVTELKNWGTWYVNTTNVDGFRLDAVKHIKYSFFPDWLTYVRSQTQKNLFAVGEFWSYDVNKLHNYITKTSGTMSLFDAPLHNNFYTASKSSGYFDMRYLLNNTLMKDQPSLAVTLVDNHDTQPGQSLQSWVEPWFKPLAYAFILTRQEGYPCVFYGDYYGIPKYNIPGLKSKIDPLLIARRDYAYGTQRDYIDHQDIIGWTREGIDSKPNSGLAALITDGPGGSKWMYVGKKHAGKVFYDLTGNRSDTVTINADGWGEFKVNGGSVSIWVAKTSQVTFTVNNATTTSGQNVYVVGNIPELGNWNTANAIKMTPSSYPTWKTTIALPQGKAIGGVRHGP

SEQ ID NO: 137 - DNA, 1320 bp, Unknown
  Obtained from an environmental sample.
gtgggacgggcaggcttggcgcatcactcgaacacttccgccaaggggacatacgggtcacctctcgaactgcgtccggatcgccccgccgtggccggggcggtcgagcttgaagatgtccagcggggagccgccgccgaggatcaccccggcggcgtactcgcccagggcggggctcagcttgaagccgtggccggagccgcctcccaggagccagacgttggaggcccgcggatggcggtcgaggaggaggtggccgtcggggctgttctcgtactggcagacgcgggtctcgaccagcggcgcgtccttcagggccgggaaccggcgggccacctcggcccgggccgcttccagcagggccggggtgatcgtccgctcgcccgccgtgggatcgatgggctcgccccgggtgtcgtccgccaccttgaagccgcggtgctcgttgccggggatgccgtagtagatccgctcgccgagatcgacccagaccggacagccgccctcctggaagcgcgggtcgcccggcggcgtgccgaagaagaacacctcctggcgggtgttgcggaggaaccgctcaccgatcacgtccgggaacagcccggccagccagggaccgcaggcgaagacgtagaggtcggccgcgagagtggagccgtccgaaaggtgaagccgctccaagggccccgggaccatggcggcctgccggtactccccgccctcgccctggaacagctccaccacggtccggcaggcgcgccgggcgaacagggcgccggcttcctcctcgtaccagatcgtgcggacgccgtcgaaatcgacctgggggaagcggctccgggcctccccctgagacagctcggcgaccggcagccccgcgtcctccagaaaaggaagggagtcgcggacgtagctgtcgtcctcgccgcacatccagaggaccccggtccttttgtacagccggtaaccggactggacttcggcgtcccgccagagctcgaaggagcgggcgacccactccacgtacagacggtcgggtccgtaggcgccgcggatgatccgcgtctcgccaccggagctggagcgggagtgccccggaccccaggcgtccaggagggtcacccgggctccgcggcggaggagatgcagggcggtccagccgccgaaggcgccggcgccgacgacggcgatatggggatgggagggcatggcgggcgtaaggttatcgcagcccgatccttcgctggcatcccatctccgaccggagtatcctggaaaattcgaagaaggagatcgacatgcaatcgaacggaaacgtga

SEQ ID NO: 138 - protein, 439 aa, Unknown
  Obtained from an environmental sample.
VGRAGLAHHSNTSAKGTYGSPLELRPDRPAVAGAVELEDVQRGAAAEDHPGGVLAQGGAQLEAVAGAASQEPDVGGPRMAVEEEVAVGAVLVLADAGLDQRRVLQGREPAGHLGPGRFQQGRGDRPLARRGIDGLAPGVVRHLEAAVLVAGDAVVDPLAEIDPDRTAALLEARVARRRAEEEHLLAGVAEEPLTDHVREQPGQPGTAGEDVEVGRESGAVRKVKPLQGPRDHGGLPVLPALALEQLHHGPAGAPGEQGAGFLLVPDRADAVEIDLGEAAPGLPLRQLGDRQPRVLQKRKGVADVAVVLAAHPEDPGPFVQPVTGLDFGVPPELEGAGDPLHVQTVGSVGAADDPRLATGAGAGVPRTPGVQEGHPGSAAEEMQGGPAAEGAGADDGDMGMGGHGGRKVIAARSFAGIPSPTGVSWKIRRRRSTCNRTET

SEQ ID NO: 139 - DNA, 1524 bp, Unknown
  Obtained from an environmental sample.
atgaaaacattcaaccttaaacccacacttttacctttaactttgctgctgagttcgccggtattggcggcacaaaatggaactatgatgcagtatttccattggtatgtgccaaatgacggcgcactctggacacaagttgaaaacaatgcgccagcactatccgacaacggttttacagcgctgtggttgccaccagcatataaaggcgcaggtggtagcaacgacgttggttacggtgtttacgatatgtatgacttaggggagtttgatcaaaaaggatcggtacgaactaagtacggcaccaaagaccaatatctaaatgccatcaaagcagcacacaaaaacaatatccaaatttatggtgacgtagtgttcaaccatcgtggcggtgcagatggcaagtcgtgggtcgataccaagcgtgtggattggaataaccgcaatattgaacttggcgataaatggattgaagcatgggttgaatttagcttcccaggacgtaacgataaatactcagacttccattggacgtggtatcactttgatggcgtcgattgggatgacgcaggtaaagagaaagcgatctttaaattcaaaggtgatggtaaagcatgggattgggaagtcagttctgaaaaaggcaactatgactacctcatgtacgcagacttagacatggatcacccagaagtgaagcaagagctgaaagattggggtgaatggtacttaaacatgacgggtgttgatggcttccgaatggatgcagtgaaacacatcaaatatcagtacctacaagagtggatcgattacttgcgtaagaaaacgggcaaagagctctttaccgttggtgagtactggaactacgacgtgaacaatctgcacaactttatgactaagacttctggcagcatgtcattgtttgatgcgcctttacatatgaacttctataacgcttcacgctctggtggcaactttgatatgcgccgaatcatggatggcaccttgatgaaagacaacccagtgaaagcagtaacactggttgagaaccatgatacgcaaccactacaggccttagagtctccggtggattggtggttcaaaccacttgcgtacgcgttcattttgcttcgtgaggaaggttatccgtcagtcttctacgcagattactacggtgcgcaatacagcgataaagggcacgatatcaacatggtgaaagtgccttacattgagcaattggtgaaagcgcgtaaagattatgcttatggtaaacaacattcttaccttgaccactgggatgtgattggttggacacgagaaggggatgcggaacatccgaactctatggcggttatcatgagtgatggtcctggcggaacaaagtggatgtacacaggttcaccgagcacacgttatgtcgataaactaggtattcgtaccgaagaagtatggactaacgctagtggatgggccgaattcccagtgaacggcggatcggtttctgtttgggttggcgttaaataa

SEQ ID NO: 140 - protein, 507 aa, Unknown
  Obtained from an environmental sample.
MKTFNLKPTLLPLTLLLSSPVLAAQNGTMMQYFHWYVPNDGALWTQVENNAPALSDNGFTALWLPPAYKGAGGSNDVGYGVYDMYDLGEFDQKGSVRTKYGTKDQYLNAIKAAHKNNIQIYGDVVFNHRGGADGKSWVDTKRVDWNNRNIELGDKWIEAWVEFSFPGRNDKYSDFHWTWYHFDGVDWDDAGKEKAIFKFKGDGKAWDWEVSSEKGNYDYLMYADLDMDHPEVKQELKDWGEWYLNMTGVDGFRMDAVKHIKYQYLQEWIDYLRKKTGKELFTVGEYWNYDVNNLHNFMTKTSGSMSLFDAPLHMNFYNASRSGGNFDMRRIMDGTLMKDNPVKAVTLVENHDTQPLQALESPVDWWFKPLAYAFILLREEGYPSVFYADYYGAQYSDKGHDINMVKVPYIEQLVKARKDYAYGKQHSYLDHWDVIGWTREGDAEHPNSMAVIMSDGPGGTKWMYTGSPSTRYVDKLGIRTEEVWTNASGWAEFPVNGGSVSVWVGVK

SEQ ID NO: 141 - DNA, 1401 bp, Unknown
  Obtained from an environmental sample.
atgaaaccaataaataccctactcatatccgcccttgctgtttgttctttcagttccgcgacttacgccgatactattttgcacgcgttcaattggaagtattcagatgtgacggccaacgcgaatcaaattgctcaagctggttataagaaagtgcttgttgcgcctgcaatgaaatcgagtggcagccaatggtgggctcgctatcaacctcaagatctacgcactatcgattctcctttgggcaataaacaagatttagccgcaatgattgccgcactcaaaggtgtgggcgtcgatgtgtatgccgatgtggtactcaaccatatggcgaatgaaagctggaagcgaagtgacttgaattaccctggcacagaagtgctaaacgattatgctagccgttcaagctactatgctgaccagactctgtttggcaacctagcacaaggttatgtgtcagcgaacgactttcatccagcgggctgtatttcagattggaacgaccctggtcatgttcagtattggcgtttgtgtggcgcagatggtgatgtaggtttacctgaccttgatccaaacaactgggtggtttcacaacagcgtttgtatctgaaagcgctaaaagatatgggcatcaaagggttccgaattgatgcagtgaagcacatgagccaataccaaatcgatcaggtattcacgtctgaaattactgcgaacatgcatgtgtttggtgaagtgattactagcggtggagcagggaatagcggctatgaatcgttcttagcgccttacctgaataatactaatcactctgcctacgatttcccgctgtttgcatcgattcgctcggcattttctatggggggcggtttaaatcaactgcatgatcctaaagcgtacggtcaggcacttgatgataatcgctcgatcacctttgcgatcacacatgatattccaaccaatgacggcttccgctaccaaattatggacccacaagacgagcagcttgcttacgcgtatatccttggtaaagacggtggcacgccgctgatctacagtgatgatcttcctgattctgaagacaaggataacggtcgttggggcaatgtttggaacagttcgacaatgaaaaacatgttgagcttccataacgcgatgcaaggcaaaacaatgacgatgatttctagcgaccattgcactttgttgtttaagcgtggcaaagaaggtgttgtgggtattaacaagtgtggtgaaacgcgtggcgtgacggttgatacctaccaacatgagtttaattggcatgttcaatacaaagacgtgttaagcagcgcaacagaaaccgtgacttctcgttaccatacgttcaatctaccaccacgcagtgcgcgtatgtttaagctgtag

SEQ ID NO: 142 - protein, 466 aa, Unknown
  Obtained from an environmental sample.
MKPINTLLISALAVCSFSSATYADTILHAFNWKYSDVTANANQIAQAGYKKVLVAPAMKSSGSQWWARYQPQDLRTIDSPLGNKQDLAAMIAALKGVGVDVYADVVLNHMANESWKRSDLNYPGTEVLNDYASRSSYYADQTLFGNLAQGYVSANDFHPAGCISDWNDPGHVQYWRLCGADGDVGLPDLDPNNWVVSQQRLYLKALKDMGIKGFRIDAVKHMSQYQIDQVFTSEITANMHVFGEVITSGGAGNSGYESFLAPYLNNTNHSAYDFPLFASIRSAFSMGGGLNQLHDPKAYGQALDDNRSITFAITHDIPTNDGFRYQIMDPQDEQLAYAYILGKDGGTPLIYSDDLPDSEDKDNGRWGNVWNSSTMKNMLSFHNAMQGKTMTMISSDHCTLLFKRGKEGVVGINKCGETRGVTVDTYQHEFNWHVQYKDVLSSATETVTSRYHTFNLPPRSARMFKL

SEQ ID NO: 143 - DNA, 1422 bp, Unknown
  Obtained from an environmental sample.
atgccaaagagcacttttaccaaatccataacaaaatcacttcttgctacttccgttgttgtaagcttattgcctgcctacgcacaggccgacactatcttgcatgcctttaactggaaatacagcgacattacccgccaagcagagcaaattgcgcaagctggttataaaaaagtactgatttcaccgccgctgaagtccacaggcccacaatggtgggcacgttaccaaccacaggacattcgagtgattgactcccctgtcggcaacaagcaagatttacaagccctcattgcagccttaaaggcacaaggcgttgaagtatacgcagacatcgtactcaaccacatggccaacgaaagctggaaacgagacgatctgaactacccgggaagtgatttacttacccaatacagccaaaatatggcttacatgaaccagcaaaaattgtttggagatttagagcaaaatcagttctctgccaatgattttcacccggctggctgcattactgattggagtaacccggggcatgttcaatactggcgcttatgtggtggtaatggtgacactgggttacctgatcttgatcctaactcgtgggtgatcgatcaacaaaaacgttatttacgtgctttgaaagacatgggaataaagggcttccgagttgatgcggtaaaacacatgagcgattaccaaatcaaccaagtgtttacgccagacatcatcgcaggcttacatgtatttggtgaagtgatcaccagtggtggcaagggcagcaatgactaccactcttttctggaaccgtatttaaataacaccaatcacgccgcgtatgacttcccgctatttgcctctatccgaaatgcatttagttatcatggcagcttgtctcaattacatgatccacaagcttacgggcaagcacttcctaacgacagagccattactttcaccatcactcacgacattccaaccaatgatggtttccgttaccaaatcatggatccaaccagtgaaaaactcgcgtacgcgtacattctaggcaaagatgggggtagcccacttatctatagcgatgctttagacccaagtgaagataaagataagggccgctggcgtgatgtatggaaccaagaatacatggttaacatgatcagcttccacaacaaggtgcaaggtaaaagcatggaggtcatgtacagcgatcaatgcttgctggtctttaaacgtgaaaaacaaggcttagtcggtattaataagtgcgctgaaagccgtacctacaccatagatacccatcgttttgaatttaactggtaccaaccgtacaacgacacattaagccagcacagcgagacctttagcagccgttatcatgctctgaccattccggcgcaaacagcacgaatgttggcgctataa

SEQ ID NO: 144 - protein, 473 aa, Unknown
  Obtained from an environmental sample.
MPKSTFTKSITKSLLATSVVVSLLPAYAQADTILHAFNWKYSDITRQAEQIAQAGYKKVLISPPLKSTGPQWWARYQPQDIRVIDSPVGNKQDLQALIAALKAQGVEVYADIVLNHMANESWKRDDLNYPGSDLLTQYSQNMAYMNQQKLFGDLEQNQFSANDFHPAGCITDWSNPGHVQYWRLCGGNGDTGLPDLDPNSWVIDQQKRYLRALKDMGIKGFRVDAVKHMSDYQINQVFTPDIIAGLHVFGEVITSGGKGSNDYHSFLEPYLNNTNHAAYDFPLFASIRNAFSYHGSLSQLHDPQAYGQALPNDRAITFTITHDIPTNDGFRYQIMDPTSEKLAYAYILGKDGGSPLIYSDALDPSEDKDKGRWRDVWNQEYMVNMISFHNKVQGKSMEVMYSDQCLLVFKREKQGLVGINKCAESRTYTIDTHRFEFNWYQPYNDTLSQHSETFSSRYHALTIPAQTARMLAL

SEQ ID NO: 145 - DNA, 1542 bp, Unknown
  Obtained from an environmental sample.
atgttgaaaaggattacggtagtctgtttattatttattttgctttttcctaatatatatgggaggaataaggcggaagcagcaacgataaataatggaacattaatgcagtattttgagtggtacgctccgaatgatgggaatcattggaatcgtttgcgttatgatgctgaaagtttagctcataagggaatcacatctgtatggataccacctgcatataaagggacttcgcaaaatgatgtagggtatggggcctatgatttatacgatttaggggagttcaatcaaaaaggaacggtgcggacgaaatatgggacaaaggcacagttgaaatctgcaattgacgctttacataagcaaaacatcgacgtatacggtgatgtagttatgaatcataaaggtggggctgattatactgaaaccgtaacagctgttgaggtagaccgtaacaatcgaaatattgaagtatcaggtgattatgaaattagtgcgtggacgggttttaactttccagggcgcagagatgcttattctaatttcaaatggaaatggtatcattttgacggaacggattgggatgaaggaaggaaattaaaccgaatttataaatttaggggtataggtaaagcgtgggactgggaagtgtctagcgaaaatggaaattatgattatttgatgtatgcagatcttgattttgatcatccagatgttgcgaatgaaatgaaaagttggggaacgtggtatgcgaatgaattaaatttagatggatttcgtttagatgctgttaaacatattgatcatgaatatttacgcgattgggtaaatcatgtcagacagcaaacggggaaagaaatgtttacggtggctgaatattggcaaaatgatatccagactttaaacaattatttggcgaaagtcaattataatcaatctgtatttgatgcaccgcttcattacaattttcattatgcttcaacaggaaatgggaattatgatatgagaaatattttaaatggaacagtaatgaaaaatcatcctgcactcgcagttactctcgttgagaatcatgattctcaacctgggcaatcattggaatctgtagtaagtccgtggtttaagccgctggcatatgcatttattttaactcgtgcagagggctatccttcagttttttatggtgattactatgggacaagcggaaatagtagttatgaaattccagcgttaaaagataaaattgatccaattttgacggcacgaaaaaactttgcatatggtacgcagcgtgattatttagaccatccagatgtgattggctggacaagagaaggagatagtgtacatgctaagtctggtttagcggcattaatctccgatggaccaggaggatcaaagtggatggatgttggaaagaataacgctggggaagtatggtacgatattacgggtaatcaaacaaatactgtaacaattaataaagatggatcggggcaattccatgtaagtggaggctctgtttctatatatgttcaacagtaa

SEQ ID NO: 146 - protein, 513 aa, Unknown
  Obtained from an environmental sample.
MLKRITVVCLLFILLFPNIYGRNKAEAATINNGTLMQYFEWYAPNDGNHWNRLRYDAESLAHKGITSVWIPPAYKGTSQNDVGYGAYDLYDLGEFNQKGTVRTKYGTKAQLKSAIDALHKQNIDVYGDVVMNHKGGADYTETVTAVEVDRNNRNIEVSGDYEISAWTGFNFPGRRDAYSNFKWKWYHFDGTDWDEGRKLNRIYKFRGIGKAWDWEVSSENGNYDYLMYADLDFDHPDVANEMKSWGTWYANELNLDGFRLDAVKHIDHEYLRDWVNHVRQQTGKEMFTVAEYWQNDIQTLNNYLAKVNYNQSVFDAPLHYNFHYASTGNGNYDMRNILNGTVMKNHPALAVTLVENHDSQPGQSLESVVSPWFKPLAYAFILTRAEGYPSVFYGDYYGTSGNSSYEIPALKDKIDPILTARKNFAYGTQRDYLDHPDVIGWTREGDSVHAKSGLAALISDGPGGSKWMDVGKNNAGEVWYDITGNQTNTVTINKDGSGQFHVSGGSVSIYVQQ

SEQ ID NO: 147 - DNA, 2343 bp, Unknown
  Obtained from an environmental sample.
atgagcttaaataactttaaggtaaaactgcttagttttgctgtgtcttctgctgtattgtcactggctccaaatttagccaatgctgcaaattttgaaagtgagatggtgataatccatccgtttcagtggacatatgacaatatagcaaaagagtgtacagagtaccttggtccagccggatttgacggtgtacagatttcccagccagcggaacataagcgggctgaaggagtatggtgggccgtatatcagccggttaattataagaattttacaaccatgaccggtaacgaggagcagcttaaggcaatgatcaagacctgtaatgatgcaggtgttaaggtgttcgctgacgctgttttcaaccaaaaggctacagacggtgtaggctggggcggttcaacttggagttataagaactaccctgacggattctccggatcagatttccatggagactgttccattgacaaaagctatactgatgcaaataatgtcagaacctgtgcactctcaggtatgccggacgttgccacagataactccgctactcaggaaaagattgcagattacctcgcttctttaatgaatatgggggtctatggtttccgtattgacgctgcaaagcacatgggatacaacgatatcaactccattctttcaaaaactgcacagaagactggaagaagacctcctgcatatctggaagtaatcggagccggtaacgaagctgccgacattcagccggacaagtatacctttattgagaatgcggttgtaactgacttcggttatgtctgggatgcaaatgagagtttcggaaagggtaattacggtaaggcactggaactcagtacctggctcggtgcaaattcagaaacattcgtaaacaatcatgatgatgaatggggcagatgctcagccggtagctgctcaatgaaaactcagaattatgctgattataatctggctcagtcctggcttgctgtatggcctgtaggtacagtaagacagatatattccggttattcattccctgtaaaagataatgatccttatcgcgtcagtgatgcaactcatgatcagggcgggcctcttggtgccgaccgctgtgaaggtggctggttgtgtcagcaccgtgtgtccttcgttctcaattccccaagatttgcgagagctaccagaggtactgctgtatcaaccaagggatttgacaatggtgctttgtggtttaacagaggaagcaaaggtttttatgcacagaatactaccaacagtcctataacccagacattctctgttgaagtacctgacggaaattactgtgatatcttaggaacatcagatcctaagagcaatccatgcggagcagacgttgtcgtaagcggcggtaaggctacctttactattcctgcaaagacagctgtggctatctgtacagactcagactggtgcggcaagggggttgatccttgtgaaagtgatccgaccggtgctgcctgtgtttgtaagggggaaaccaccgttaatggtgtgtgcgtcagctggtgtaatgcgcattcatcaaatgaggaatgcacctgtgtattgaatccgaatgatgccaactgtcaggctgatattgaacctaccaagggtaaactctgttacgccggtacttcaaacgggtggaaacaggatcctttaacatataaccgtaaaacaggtttctggactattaatctgactcttgacggtgcaggtgataccagcggagctcagcgcttcaaggttacagacggatgttcatggaccggaacagtttacggttcttcaggtactgccggaaagttggatgtaaatacatcatcaaccggcgatgaacctgtgtctcttgttggtgattatgttctttccattaacgataagaccatggaatatacattcaccaaggcagatgaagtaactaatcagccaccggttgcatcatttaccgcgacagttaacggtctgaccgtttcttttgccaataattcatccgaccctgagaatgatgaattaacctacagctggaatttcggtaatggtaaaacatcatccgagaaagctcctagcataacctatgaagaatccggtaagtatactgttactttaaaggttactgattcagctaataacactgatacatttactaaagatataactgtaacagcaccttctagtggcaagtacttaaaggttgcagtcagaggttcgcatgataattacggaactgatctgttaaccaagaacggttctgattggaccggcgtctttgaattctttggatccactagtgtcgacctgcaggcgcgcgagctc

SEQ ID NO: 148 - protein, 781 aa, Unknown
  Obtained from an environmental sample.
MSLNNFKVKLLSFAVSSAVLSLAPNLANAANFESEMVIIHPFQWTYDNIAKECTEYLGPAGFDGVQISQPAEHKRAEGVWWAVYQPVNYKNFTTMTGNEEQLKAMIKTCNDAGVKVFADAVFNQKATDGVGWGGSTWSYKNYPDGFSGSDFHGDCSIDKSYTDANNVRTCALSGMPDVATDNSATQEKIADYLASLMNMGVYGFRIDAAKHMGYNDINSILSKTAQKTGRRPPAYLEVIGAGNEAADIQPDKYTFIENAVVTDFGYVWDANESFGKGNYGKALELSTWLGANSETFVNNHDDEWGRCSAGSCSMKTQNYADYNLAQSWLAVWPVGTVRQIYSGYSFPVKDNDPYRVSDATHDQGGPLGADRCEGGWLCQHRVSFVLNSPRFARATRGTAVSTKGFDNGALWFNRGSKGFYAQNTTNSPITQTFSVEVPDGNYCDILGTSDPKSNPCGADVVVSGGKATFTIPAKTAVAICTDSDWCGKGVDPCESDPTGAACVCKGETTVNGVCVSWCNAHSSNEECTCVLNPNDANCQADIEPTKGKLCYAGTSNGWKQDPLTYNRKTGFWTINLTLDGAGDTSGAQRFKVTDGCSWTGTVYGSSGTAGKLDVNTSSTGDEPVSLVGDYVLSINDKTMEYTFTKADEVTNQPPVASFTATVNGLTVSFANNSSDPENDELTYSWNFGNGKTSSEKAPSITYEESGKYTVTLKVTDSANNTDTFTKDITVTAPSSGKYLKVAVRGSHDNYGTDLLTKNGSDWTGVFEFFGSTSVDLQAREL

SEQ ID NO: 149 - DNA, 2502 bp, Unknown
  Obtained from an environmental sample.
atgatcttaagtaattttaaggtaaaacttcttagttttgctgtgtcttctgctgtactgacactggctgcaaatgtcgccaatgccaagaattatgaaagtgaaatggttattattcatccatttcagtggacatatgacaatatagcaaaagaatgtactgagtatctgggacctgcgggatttgacggggtgcagatttcccaggcggctgagcataaagatgccggtggtgcatggtggggtacctaccagcctgtaaacttcaagagttttactaccatggttggtaatgaagaacagcttagagcaatgattaaaacctgtaacgaggcaggtgttaaggtctttgccgatgccgtgattaatcagaaagccggcgacggtgtaggtataggtggttcaactttcggaaattataattatcctgacggatttaccagtgatgattttcatcataataactgcagtataggtaataattattcagatgcatgggtagtaagattctgtgacctcagtggcatgccggatatagcaactgataacgacagtaccagaaataagattgctgattacttcgccagccttatgaatatgggggtatacggattccgtattgatgctgccaagcactttagctatgatgatatagacgctattgtagagaaaacagcaaccaaagcaggcaggagacctcctgtctatatggaggttatcggtaatccgggtcaagaggcggatgatatccagccgaacaagtatacatggattgataatgccgttgtaacagattttacttatgctaatagcatgcataatatttttaacggaagcggttatgccaaggctttgaacatggggctagggcatgttgatgctgaaaatgccgaagtctttataagtaatcatgataatgaatggggaagaaagtctgccggttcctgctcaataagaacccagaataatccggattaccatctggctcagtcctggctcgcagtttggcctttaggcaaggttagacagatttattctgcatatcagttcccggtctttgaagatagttgtgagcgggtcagtcagcaagcccatgatcagggcggtcctatcggggcagcccgctgtgaaggtggctggttgtgtcagcaccgtgtaccgtttgtgctcaattctcctagatttgcaagagcaaccagagggacagtcgttactactaaaggttttgatgacggagctttgtggtttaacagaggaagcaagggcttctatgcccagaatactaccggcagttctataactcatacattctcagttgaattacctgatggaaattactgtgatatccttggagcaaccgatccgaagaataatccttgcggagcggatgtcactgtaagcggaggtaaagcaacctttaccattccggcaaagaccgccgtagctatctgtactgatgaaaagtggtgtggcaagggggttgacccttgtgaaagcgatcctaccggttccgcctgtgtatgtaagggtgaaaccacagttaacggcgtatgtgtaagctggtgtaatgctcactcatctaatgaagaatgtgcctgtgtgctaaatcctaatgacgctgagtgtcaggccgacattgagccgaccaagggtaaactctgctatgtaggtacctccaacaagtggactcaggaacctttaacctataatcgcaagaccggtttctggactctcaacgttgaacttgacggtaagggggataccagcggggcgcagcgctttaaagttaccgacggctgttcatggcagggtactgtttacggttcatcaggagtagaaggcagacttgacgtaaatacttcagccaccggagatgaaccggtttcactgacaggtaaatatgttctttccataaatgataagaccatggaatacacattcattcctgcaggcagtggaaacaagcctccggttgcgtcatttactccgactgttaaagatctgactgtatcttttgtcaataattcatccgaccctgagaatgatgaattaacctacagctggaatttcggtaacggtaaaacctcatctgaaaagaatccgagtgttacatatgataaagccggtaaatatactgtttcactcaaagtaaccgatactgcaaacaacactgataccaaaacactggaaatcgatttaacatctcctgttaacggaaaatattccaaggttgcagtcagaggttcacatgataactacggaacaaatctgttaaccaggaatggttcagaatggaccggtatctttgaattcagtaagacaaccaaattcaagcttgaagctctgcctcctgcagctgaccagtgtatcttcctcggcggtaatcgaggtgaggcattgactgcctccggtggatttatatctcttcctgccggaaggtatactataaagtttaatgaggaaagcaaggttcttactgcaggcgatgttgactgcaccggg

SEQ ID NO: 150 - protein, 834 aa, Unknown
  Obtained from an environmental sample.
MILSNFKVKLLSFAVSSAVLTLAANVANAKNYESEMVIIHPFQWTYDNIAKECTEYLGPAGFDGVQISQAAEHKDAGGAWWGTYQPVNFKSFTTMVGNEEQLRAMIKTCNEAGVKVFADAVINQKAGDGVGIGGSTFGNYNYPDGFTSDDFHHNNCSIGNNYSDAWVVRFCDLSGMPDIATDNDSTRNKIADYFASLMNMGVYGFRIDAAKHFSYDDIDAIVEKTATKAGRRPPVYMEVIGNPGQEADDIQPNKYTWIDNAVVTDFTYANSMHNIFNGSGYAKALNMGLGHVDAENAEVFISNHDNEWGRKSAGSCSIRTQNNPDYHLAQSWLAVWPLGKVRQIYSAYQFPVFEDSCERVSQQAHDQGGPIGAARCEGGWLCQHRVPFVLNSPRFARATRGTVVTTKGFDDGALWFNRGSKGFYAQNTTGSSITHTFSVELPDGNYCDILGATDPKNNPCGADVTVSGGKATFTIPAKTAVAICTDEKWCGKGVDPCESDPTGSACVCKGETTVNGVCVSWCNAHSSNEECACVLNPNDAECQADIEPTKGKLCYVGTSNKWTQEPLTYNRKTGFWTLNVELDGKGDTSGAQRFKVTDGCSWQGTVYGSSGVEGRLDVNTSATGDEPVSLTGKYVLSINDKTMEYTFIPAGSGNKPPVASFTPTVKDLTVSFVNNSSDPENDELTYSWNFGNGKTSSEKNPSVTYDKAGKYTVSLKVTDTANNTDTKTLEIDLTSPVNGKYSKVAVRGSHDNYGTNLLTRNGSEWTGIFEFSKTTKFKLEALPPAADQCIFLGGNRGEALTASGGFISLPAGRYTIKFNEESKVLTAGDVDCTG

SEQ ID NO: 151 - DNA, 2112 bp, Unknown
  Obtained from an environmental sample.
atgaaaactattctttcaacaatcatggtgatggcggctgcggctgccaccaccgtagaggctcaaggctggccggaaaactacggcggcgtcatgttgcagggattctactgggattcctattcagccaccaagtggactaaactggaagcacaggctgacgagatctgcaactatttctcgctggtatgggtaccacagtcggcctataccggcagcagtacctccatgggctacgacccgctgtattacttcgaccagcattcatcgttcggcaccgaagagcagctacggtcgttcatcagtacctacaagcagaaaggaactggcatcatagccgatgtagttgtcaatcaccgaaagaatgtctcaaactgggtggatttcccggccgagacctacaacggtgtaacctatcagatggtaagcaccgacatcgtttcgaacgatgacggcggaaaaacagccacttgggcaaatcaaaacggctacagtctctcctccaatgccgacgaaggcgaaggctgggacggcatgcgcgacctggaccacaagtcgcagaacgtgcagaaatcggttcttgcctacaccaaatatctggttgacgacttaggctataccggattccgctacgatatggtaaagggatttgacggatcgcatgtagccgactacaacaccaatgccggcgtgcagttctctgtcggcgaatattgggacggcactgcatcgaaagtttacagttggatcaacagcaccaaaaagagcgatgtgccgcagtcggcagccttcgacttcgctttccgatacacctgccgcgatgccgtcaacaacaagaactgggcgaacctgaagaacacttccggtatcagcgatgccgattacaggcgctattcggttacgtttgttgaaaatcacgatacggaataccgttcagctacggcttcccaggatcccatcaagggtgatacggttgccctcaatgcctggatgctggctatgccgggcacaccttgtgttttcctgaaacattggaccgactgcaaggaagagatcaagaatctcatcgaggcacgtcgcctggtcggtattcacaaccagagcacctatgccgaatggatgagcggtgcagcctacatcggacgtaccgtaacaggtacgaacggcaccttacgtgttctgtgcggctcttatcagtataatgtagccgccaactacattcagattctctcaggcaaaaactataaatactacgtactcaacacgctcgaggctccctggatcgggaaaggttccggctcgtacaccgaaggtgaaaccgtaacggttccgctcatcgccatatcggccgatgccaatgccaagctggtatataccaccgacggcacagaccccaccgcaacctcaacagccgtaaccagcggaacggaactgaccatcacttcggacgccgtcctgaaggttggtctgctttccggcggcatcgtcaggaacatacagagccgtacattcaccttccaggctgcaaacacctccgagtattacacagccaccatgcacgtatgcaaccagtccggagctctcaatccgctgtttgcctatgtttgggcaggaccggacaacgagcagattaacggcaactggccgggcaccaagctcaccgctaccattaccgaaaacaaccttacctggtacacgcagtcgttccagattccgaagaacgtggactatgtcgtgaactttgttttcaccacaaccggcggcggtacgcagacagtggatgttaccggcatgaaggccgatgtctggtacattattaacagtaccaagagcggcaacaagtacacggtaaccgacgttacctcacagtattcttcgttagaggccatctttgatgaagaaaactccggctccttccctgtctatgacctgcagggacgccgcgtcagcgaaattagaaacaggacaattatatcttcagaacggaaagaagatactcatcagataaacagaggttccgaaccattctcctattatgaaaatcagacacttagtaatctcagcactgctgggtttggggggcttgtacaccatcagctgctcctcgtcggg

SEQ ID NO: 152 - protein, 704 aa, Unknown
  Obtained from an environmental sample.
MKTILSTIMVMAAAAATTVEAQGWPENYGGVMLQGFYWDSYSATKWTKLEAQADEICNYFSLVWVPQSAYTGSSTSMGYDPLYYFDQHSSFGTEEQLRSFISTYKQKGTGIIADVVVNHRKNVSNWVDFPAETYNGVTYQMVSTDIVSNDDGGKTATWANQNGYSLSSNADEGEGWDGMRDLDHKSQNVQKSVLAYTKYLVDDLGYTGFRYDMVKGFDGSHVADYNTNAGVQFSVGEYWDGTASKVYSWINSTKKSDVPQSAAFDFAFRYTCRDAVNNKNWANLKNTSGISDADYRRYSVTFVENHDTEYRSATASQDPIKGDTVALNAWMLAMPGTPCVFLKHWTDCKEEIKNLIEARRLVGIHNQSTYAEWMSGAAYIGRTVTGTNGTLRVLCGSYQYNVAANYIQILSGKNYKYYVLNTLEAPWIGKGSGSYTEGETVTVPLIAISADANAKLVYTTDGTDPTATSTAVTSGTELTITSDAVLKVGLLSGGIVRNIQSRTFTFQAANTSEYYTATMHVCNQSGALNPLFAYVWAGPDNEQINGNWPGTKLTATITENNLTWYTQSFQIPKNVDYVVNFVFTTTGGGTQTVDVTGMKADVWYIINSTKSGNKYTVTDVTSQYSSLEAIFDEENSGSFPVYDLQGRRVSEIRNRTIISSERKEDTHQINRGSEPFSYYENQTLSNLSTAGFGGLVHHQLLLVG

SEQ ID NO: 153 - DNA, 1620 bp, Unknown
  Obtained from an environmental sample.
atgccttcaattaatgcaagcgattgcaaaaaaaagggagataggagtatgaagaggaaaaaatggactgcgttagcactatctttaccactagttatgagcttatcaacaaacatacaagcagaaacattacataataataagggtcaaaaggcgcaaacaggaaataaagacggaattttttatgaactgtatgttaattctttttatgatactgatagcaatggacatggtgatttaaaaggcgtcacaaagaaacttgattatttaaatgatggaaatccaagaacaaataatgatcttcaaataaacggtatctggatgatgcctattaacacctctcctagttatcacaaatatgatgtaacagattactataatatcgatcctcagtatggaagtttacaagatttccgtgaactaacaacagaagcgcataaacgcaacgtaaaggtagtaatagatcttgttattaatcatacaagcagtgagcatccttggtttgtcgatgcattaaaaaataaaaacagtaagtatcgagattactatatttgggctgataaaaatacagacttaaatgaaaaaggcccatggggtcaacaagtatggcacaaagcgtcgaacggagagtatttctacgcaacgttctgggaagggatgccggacttaaactatgacaaccctaaagtaagagaagaaatgattaaaatcgggaaattttggctcaaacaaggagctgatggctttcgtctagatgcagccatgcacatctttaaagggcaaacacctgaaggagcaaagaaaaatattgaatggtggaatgaattccgcgacgcgatgagagaaacgaatccaaatacgtatctagttggtgaaatatgggatcaaccagaagtagttgctccgtattatcaatcgttagattctacatttaacttcgacttagcatataaaatcgttaattccgttaaaaatggtactgatcaaggggtagccgcggcagctgttgcaacggatgagttatataaaacatataatccaaataaaattgatggaacgtttttaacgaatcatgaccaaaatcgtgtaatgagtgagttaaatggtgatgtaaacaaagcaaaatcagcagcctctattctgttgacactccctggtaatccgttcatttattatggcgaagaaatcggcatgacaggccaaaaaccagatgagttgattcgtgagcctttccgttggtatgaagatgataaagaaggtcaaacgagctgggagactccagtatataacattgatcataatggtgtttcagttgaagcacaagataaacaaaaagcttctcttctaagccattatcgtaaaatgattcgtgttcgtcagcaacacgatgaacttgtcaaaggtaatttagaacctatttctgtcaataattcacaggttgttgcctataatcgtacgtataaaaataaatcaattcaagtgtaccataatatttcagacaagccggttacattaactgtttcaaacaaaggaaaactgattttttctagtgaattaggagcaaaaaaggaaaaatcaacattagtaattccagcgaatacgacagtgctagtaaagtaa

SEQ ID NO: 154 - protein, 539 aa, Unknown
  Obtained from an environmental sample.
MPSINASDCKKKGDRSMKRKKWTALALSLPLVMSLSTNIQAETLHNNKGQKAQTGNKDGIFYELYVNSFYDTDSNGHGDLKGVTKKLDYLNDGNPRTNNDLQINGIWMMPINTSPSYHKYDVTDYYNIDPQYGSLQDFRELTTEAHKRNVKVVIDLVINHTSSEHPWFVDALKNKNSKYRDYYIWADKNTDLNEKGPWGQQVWHKASNGEYFYATFWEGMPDLNYDNPKVREEMIKIGKFWLKQGADGFRLDAAMHIFKGQTPEGAKKNIEWWNEFRDAMRETNPNTYLVGEIWDQPEVVAPYYQSLDSTFNFDLAYKIVNSVKNGTDQGVAAAAVATDELYKTYNPNKIDGTFLTNHDQNRVMSELNGDVNKAKSAASILLTLPGNPFIYYGEEIGMTGQKPDELIREPFRWYEDDKEGQTSWETPVYNIDHNGVSVEAQDKQKASLLSHYRKMIRVRQQHDELVKGNLEPISVNNSQVVAYNRTYKNKSIQVYHNISDKPVTLTVSNKGKLIFSSELGAKKEKSTLVIPANTTVLVK

SEQ ID NO: 155 - DNA, 1773 bp, Unknown
  Obtained from an environmental sample.
gtgtcaagaatgtttgcaaaacgattcaaaacctctttactgccgttattcgctggatttttattgctgtttcatttggttctggcaggaccaacggctgcgaatgctgaaacggctaacaaatcaaatgagcttacagcaccgtcgatcaaaagcggaaccattcttcatgcttggaattggtcgttcaatacgttaaaacacaatatgaaggatattcatgatgcaggatatacagcgattcagacgtctccgattaaccaagtcaaggaagggaaccaaggaaataaaaacatgtcgaactggtactggctctatcagccgacatcgtaccaaattggcaaccgttacttaggtactgaacaagaatttaaagaaatgtgtgcagccgctgaagaatatggcataaaggttattgttgacgcggtcatcaatcataccaccagtgactatgccgcgatttccaatgagattaagagtattccaaactggacacatggaaacacacaaattaaaaactggtctgatcgatgggatgtcacgcagaatgcattgctcgggctgtatgactggaatacacaaaatacacaagtacagtcctatttgaaacggttcttagaaagagcattgaatgacggggcagacggttttcgatttgatgccgccaaacatatagagcttccggatgatggcagttacggcagtcaattttggccgaatatcacaaatacatctgcagagttccaatacggagaaatcctgcaggatagtgcttcaagagatgcttcatatgcgaattatatgaatgtgacagcgtctaactatgggcattccataaggtccgctttaaagaatcgtaatctgggcgtgtcgaatatctcccactatgcatcagatgtgtctgcggacaagctagtgacatgggtagaatcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcaggctatcactgcggtcaatagatttcacaatgtgatggctggacagcctgaggaactctcgaacccaaatggaaacaaccagatatttatgaatcagcgcggctcacatggcgttgtgctggcaaatgcaggttcatcctctgtttctatcaatacgccaacaaaattgcctgatggcaggtatgataataaagctggggcaggttcatttcaagtaaatgacggtaaactgacaggcacgatcaatgccaggtctgtggctgtgctttatcctgatgatattgcaaaagcgcctcatgttttccttgagaattacaaaacaggtgtaacacattctttcaatgatcaactgacgattacactgcgtgcagatgcgaatacaacaaaagccgtttatcaaatcaataatggaccagagacggcgtttaaggatggagatcaattcacaatcggaaaaggagatccatttggcaaaacatacaccatcatgttaaaaggaacgaacagtgatggtgtaacgaggaccgaggaatacagttttgttaaaagagatccagcttcggccaaaaccatcggctatcaaaatccgaatcattggagccaggtaaatgcttatatctataaacatgatgggggccgggca

SEQ ID NO: 156 - protein, 591 aa, Unknown
  Obtained from an environmental sample.
VSRMFAKRFKTSLLPLFAGFLLLFHLVLAGPTAANAETANKSNELTAPSIKSGTILHAWNWSFNTLKHNMKDIHDAGYTAIQTSPINQVKEGNQGNKNMSNWYWLYQPTSYQIGNRYLGTEQEFKEMCAAAEEYGIKVIVDAVINHTTSDYAAISNEIKSIPNWTHGNTQIKNWSDRWDVTQNALLGLYDWNTQNTQVQSYLKRFLERALNDGADGFRFDAAKHIELPDDGSYGSQFWPNITNTSAEFQYGEILQDSASRDASYANYMNVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTPTKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEEYSFVKRDPASAKTIGYQNPNHWSQVNAYIYKHDGGRA

SEQ ID NO: 157 - DNA, 1596 bp, Unknown
  Obtained from an environmental sample.
atgcaaacgattgcaaaaaaaggggatgaaacgatgaaagggaaaaaatggacagcattagctctaacactgccgctggctgctagcttatcaacaggcgttcacgccgaaaccgtacataaaggtaaagctccaacagcagataaaaacggtgtcttttatgaggtgtatgtaaactctttttacgatgcaaataaagatggacatggtgatttaaaaggtcttacacaaaagctggattatttgaatgacggcaattctcataccaaaaatgatcttcaagtaaacggaatttggatgatgccggtaaacccttctcctagctatcataaatatgatgtaacggactattataacattgatccgcagtacggaaatctgcaagattttcgcaagctgatgaaagaagcagataaacgagacgtaaaggttattatggacctcgttgtgaatcatacaagcagtgaacatccttggtttcaagctgcattaaaagataaaaacagcaagtacagagattactatatttgggccgataaaaatactgatttaaatgaaaaaggatcttgggggcagcaagtatggcataaagctccaaacggagagtatttttatggtacgttttgggaaggaatgcctgacttaaattacgataatcccgaagtaagaaaagaaatgattaacgtcgggaaattttggctaaagcaaggcgttgacgggttccgcttagatgctgcgcttcatatttttaaaggtcaaacacctgaaggcgctaagaaaaatatcgtgtggtggaatgagtttagagatgcaatgaaaaaagaaaaccctaacgtatatctaacgggtgaagtatgggatcaaccggaagtagtagctccttactatcaatcgcttgattctttatttaactttgatttagcaggaaagattgtaaactctgtaaaatcaggaaatgatcaaggaatcgcgactgcagcagccgcaactgatgagctgttcaaatcatacaatccaaataaaattgacggcattttcttaaccaaccatgaccaaaatcgcgtcatgagtgagctaagcggcgatgtgaataaagcaaagtcagctgcctctatcttacttacgcttcctggcaacccgtatatttattacggtgaagaaattggaatgaccggtgaaaagcctgatgagttaatccgtgaaccgttccgctggtacgaaggcaatggacttggacaaaccagctgggaaacatccgtatacaacaaaggcggcaatggtgtgtcagtagagacacaaacaaaacaaaaggattctttgttaaatcattaccgtgaaatgattcgcgtgcgtcagcagcatgaagagttagtaaaaggaacccttcaatctatttcagtagacagtaaagaagtcgttgcctatagccgcacgtataaaggcaaatcgattagcgtgtatcataatatttcaaatcaaccggtaaaagtatctgtaacagcgaaaggtaaattgatttttgctagtgaaaaaggtgcaaaaaaagtcaaaaatcagcttgtggttccagctaatacaacggttttaataaaataa

SEQ ID NO: 158 - protein, 531 aa, Unknown
  Obtained from an environmental sample.
MQTIAKKGDETMKGKKWTALALTLPLAASLSTGVHAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNIVWWNEFRDAMKKENPNVYLTGEVWDQPEVVAPYYQSLDSLFNFDLAGKIVNSVKSGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETSVYNKGGNGVSVETQTKQKDSLLNHYREMIRVRQQHEELVKGTLQSISVDSKEVVAYSRTYKGKSISVYHNISNQPVKVSVTAKGKLIFASEKGAKKVKNQLVVPANTTVLIK

SEQ ID NO: 159 - DNA, 1587 bp, Unknown
  Obtained from an environmental sample.
atgcaaaaaaaaggggatgaaacgatgaaagggaaaaaatggacagctttagctctaacactgccgctggctgctagcttatcaacaggcgttcacgccgaaaccgtacataaaggtaaatctccaacagcagataaaaacggtgtattttatgaggtgtatgtaaactctttttacgatgcaaataaagatggacatggtgatttaaaaggtcttacacaaaagttggattatttaaatgatggcaattctcatacaaagaatgatcttcaagtaaacgggatttggatgatgccggtcaacccttctcccagctatcataaatatgatgtaacggactattataatattgatccgcagtatggaaatctgcaagattttcgcaaactgatgaaagaagcagataaacgagatgtaaaagtcattatggacctcgttgtgaatcatacgagcagtgaacacccttggtttcaagctgcattaaaagataaaaacagcaagtacagagattactatatctgggctgataaaaataccgacttgaatgaaaaaggatcttggggacagcaagtatggcataaagctccaaacggagagtatttttacggaacgttttgggaaggaatgccggacttaaattacgataatcctgaagtaagaaaagaaatgattaacgtaggaaagttttggctaaagcaaggagttgatgggttccgtctagatgctgcgcttcatatttttaaaggccaaacacctgaaggcgctaagaaaaatctcctgtggtggaatgaatttagagatgcaatgaaaaaggaaaaccctaacgtatatctaacgggtgaagtatgggatcaaccggaagtagtagctccttactatcaatcgcttgattctttatttaactttgatttagcaggaaagattgtaaactctgtaaaatcaggaaatgatcaaggaatcgcgactgcagcagcggcaacggatgaactgttcaaatcatacaatccaaataaaattgacggtattttcttaaccaaccatgaccaaaatcgcgtcatgagtgagctaaacggcgatgtgaataaagcaaagtcagctgcctctatcttacttacgcttcctggcaacccgtatatttattacggtgaagaaatcggcatgaccggtgaaaagcctgatgagttaatccgtgaaccgttcccctggtacgaaggaaacggacttggacaaaccagctgggaaacacctgtatataacaaaggcggcaacggcgtgtctgtagaagcacaaacaaaacaaaaggactctttgttaaatcattaccgtgaaatgattcgcgtgcgtcagcagcacgaagagttagtaaaaggaacgcttcaatctatttcagtagacagtaaagaagtcgttgcctatagccgtacgtataaaggcaaatcgattagcgtgtatcataatatttcaaatcaaccggtaaaagtatctgtagcagcaaaaggtaaattgatttttgctagtgaaaaaggtgctaagaaagtcaaaaatcagcttgtgattccggcgaatacaacggttttaataaaataa

SEQ ID NO: 160 - protein, 528 aa, Unknown
  Obtained from an environmental sample.
MQKKGDETMKGKKWTALALTLPLAASLSTGVHAETVHKGKSPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVNSVKSGNDQGIATAAAATDELFKSYNPNKIDGIFLTNHDQNRVMSELNGDVNKAKSAASILLTLPGNPYIYYGEEIGMTGEKPDELIREPFPWYEGNGLGQTSWETPVYNKGGNGVSVEAQTKQKDSLLNHYREMIRVRQQHEELVKGTLQSISVDSKEVVAYSRTYKGKSISVYHNISNQPVKVSVAAKGKLIFASEKGAKKVKNQLVIPANTTVLIK

SEQ ID NO: 161 - DNA, 1623 bp, Bacterial
gtggatccaaagaattgtagtcaatttatgcaaacgattgcaaaaaaaggggatgaaacgatgaaagggaaaaaatggacagctttagctctaacactgccgctggctgctagcttatcaacaggtgttcacgccgaaaccgtacataaaggtaaagctccaacagcagataaaaacggtgtcttttatgaggtatatgtaaactctttttacgatgcaaataaagatggacatggtgatttaaaaggccttacacaaaagttggactatttaaatgacggaaattctcatacaaagaatgatcttcaagtaaacgggatttggatgatgccggtcaacccttctcctagctatcataaatatgatgtaacggactattataatattgatccgcagtatggaaatctgcaagattttcgcaaacttatgaaagaagcagataaacgagacgtaaaagtcattatggaccttgttgtgaatcatacgagcagtgaacacccttggtttcaagctgcgttgaaagataaaaacagcaagtacagagattactatatttgggctgataaaaatactgacttgaatgaaaaaggatcttggggacaacaagtatggcataaagctccaaacggagagtatttttacggaacgttctgggaaggaatgcctgacttaaattacgataaccctgaagtaagaaaagaaatgattaacgtcggaaagttttggctaaaacaaggcgttgacggcttccgcttagatgctgcccttcatatttttaaaggtcaaacgcctgaaggcgctaagaaaaacattctatggtggaatgagtttagagatgcgatgaaaaaagaaaacccgaacgtatatctaacgggtgaagtgtgggaccagccagaagtagtagccccttactatcaatcacttgattctctatttaattttgatttagcaggaaaaattgtcagctctgtaaaagcaggaaatgatcaaggaatcgccactgcagcagcggcaactgatgagctgttcaaatcatacaatccaaataaaattgacggcattttcttaaccaaccatgaccaaaatcgcgtcatgagtgagttaagcggcgatgtgaataaagcaaaatcagccgcctctatcttacttacgcttcctggaaatccgtatatttattacggtgaagaaattggcatgacaggtgaaaagcctgatgaattaatccgtgaaccgttccgctggtacgaaggcaacggaattggacaaactagctgggaaacacctgtatataacaaaggcggtaacggcgtgtctgtagaagcacaaacaaaacaaaaggattccttgttaaatcattaccgtgaaatgattcgtgtgcgccagcagcacgaagagttagtaaaaggaacgcttcaatccatttcagtagacagtaaagaagtcgttgcctatagccgcacgtacaaaggcaaatcgattagcgtgtatcataatatttcaaatcaacctgtaaaagtatctgtagcagcgaaaggtaacttgatttttgctagtgaaaaaggtgctaagaaagtcaaaaatcagcttgtgattccggcgaatgcgacggttttaataaaataa

SEQ ID NO: 162 - protein, 540 aa, Bacterial
VDPKNCSQFMQTIAKKGDETMKGKKWTALALTLPLAASLSTGVHAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGIGQTSWETPVYNKGGNGVSVEAQTKQKDSLLNHYREMIRVRQQHEELVKGTLQSISVDSKEVVAYSRTYKGKSISVYHNISNQPVKVSVAAKGNLIFASEKGAKKVKNQLVIPANATVLIK

SEQ ID NO: 163 - DNA, 1422 bp, Unknown
  Obtained from an environmental sample.
atggtacgtcccgaacgacgggctgcattggaaccgactatcgaacgactcgcagcacttgaaagacattgggtgacgacggtgtggattccgccggcgtacaaaggcacgtcacagaacgatgtcgggtatggggcgtacgatttatacgatctcggcgaattcaaccaaaaagggacgacccggacgaagtacgggacgaaagcgcagctccagaccgccatctcgaacttgcgcggtaaagggatcggtgtgtacggcgacgtcgtcatgaatcacaagggcggggccgattataccgaatccgttcaggcgatcgaggtcaatccgtcgaaccggaaccaagaaacgtccggtgagtatggcatctcggcctggactgggttcaacttcgcggggcgcaacaatacatactcgccgttcaaatggcgctggtaccattttgacggtaccgattgggatcagtcacgcagcttgagccgcatctataagttcaagagcacaggcaaggcgtgggacacggacgtgtcgaacgagaacggcaactatgattatcttatgtatgccgacgtcgatttcgagcatcccgaggtccgccaagagatgaagaactggggcaaatggtacgccgactcgctcgggctcgacggtttccggttggatgcggtcaaacatatcagccactcgtacttgaaggagtgggtgacgagcgtgcgccagacgaccgggaaagagatgttcacggtcgccgagtattggaagaacgatctcggtgccatcaacgactatctgtataagacgggctacacgcactccgtcttcgatgtgccgctccattataacttccaagcggccggtaacggcggcgggtattacgatatgcgcaacatcttgaaaggcaccgtcaccgaacagcatccgtcgctgtccgtgacgattgtcgataaccacgactcacagccgggccagtcgctcgagtcgacggtcgccaactggttcaaaccgctcgcctacgcgacgatcatgacgcgcggtcagggttatccggccctcttctatggagactattatggcacgaaagggacgacgaaccgcgaaatcccgaacatgtcgggcacgctccaaccgattttgaaggcacgaaaagacttcgcctacgggacgcagcatgactacctcgatcatcaggacgtcatcggctggacacgtgaaggtgtgaccgaccgtgccaaatcgggtctcgcgacgattctatcggacggtccgggcggctcgaagtggatgtacgtcggcaaacagaacgccggcgaggtatggaaagacatgacgaacaacaacgcccgtctcgtcacgatcaatgctgacggctggggtcagttcttcgtcaacggaggctcggtctcgatttatacgcaacaataa

SEQ ID NO: 164 - protein, 473 aa, Unknown
  Obtained from an environmental sample.
MVRPERRAALEPTIERLAALERHWVTTVWIPPAYKGTSQNDVGYGAYDLYDLGEFNQKGTTRTKYGTKAQLQTAISNLRGKGIGVYGDVVMNHKGGADYTESVQAIEVNPSNRNQETSGEYGISAWTGFNFAGRNNTYSPFKWRWYHFDGTDWDQSRSLSRIYKFKSTGKAWDTDVSNENGNYDYLMYADVDFEHPEVRQEMKNWGKWYADSLGLDGFRLDAVKHISHSYLKEWVTSVRQTTGKEMFTVAEYWKNDLGAINDYLYKTGYTHSVFDVPLHYNFQAAGNGGGYYDMRNILKGTVTEQHPSLSVTIVDNHDSQPGQSLESTVANWFKPLAYATIMTRGQGYPALFYGDYYGTKGTTNREIPNMSGTLQPILKARKDFAYGTQHDYLDHQDVIGWTREGVTDRAKSGLATILSDGPGGSKWMYVGKQNAGEVWKDMTNNNARLVTINADGWGQFFVNGGSVSIYTQQ

SEQ ID NO: 165 - DNA, 1437 bp, Bacterial
atgcagtatttcgagtggtacgtgccaaatgatggggaacattggaatcgtttgcgtaatgatgctgaaaatttagctcataaaggaattacatctgtatggataccacccgtatataaaggaacttcacaaaatgatgtagggtatggagtgtatgatgtatatgatttgggagaattcaatcaaaaaggaacgatacggacaaaatatgggacaaaagcacaattaaaatctgcaattgaggctttacataatcaaaatatcgatgtatacggtgatgttgttatgaaccataaaggtggggcagattatactgaggttgtaacagccgttgaggtagaccgtaacaatcgaaatattgaaacatcgagtgattatcaaatagatgcgtggacgggatttgattttccaggacgcagggactcctattctaattttaaatggagatggtttcattttgatggaacagattgggatgagggaaggaaattaaatagaatttataaatttaaaggcgtaggtaaagcttgggactgggaagtgtctagtgagaatggtaactatgattatttaatgtatgcagatcttgatttcgatcatcctgaagttgcaaatgaaatgaaaaactggggaacctggtatgcggacgaattaaatttagatggctttcgtttagacgcagttaaacatattgaccatgagtatcttcgtgattgggtaaatcatgttagaaagcaaacggggaaggaaatgtttacagtagctgaatattggcaaaatgatattcgtactttaaacaattatttagggaaagtaaattataatcaatctgtgttcgatgcacctcttcattataattttcattatgcttcaacagggaatggaaattatgatatgaggaatattttaaagggtacggtagtagaaagtcatcctacacttgctgttactcttgttgagaatcatgattctcagcctggacagtcattagaatctgttgtgagtccttggtttaagccgttggcctatgcatttattttaacgcgtgcagaagggtatccttctgttttttatggagattactatggcacaaatggaaatagtagttatgaaattccaacgttaaaggataaaattgatccaattctgacggcacgaaaaaactttgcatatggtacgcaacatgattatttagaccatccagatgtgattggctggacaagagaaggggatagtatacatgctaattctggtttagcaacattaatctctgatggaccaggaggatcaaaatggatgaatgttggaaagaacaacgcaggggaaatatggtacgatattacgggcaatcaaacaaatactgtaacgattaataaagatggatgggggcagttccatgtaaatgggggctctgtttcaatatatgttcagaagtaa

SEQ ID NO: 166 - protein, 478 aa, Bacterial
MQYFEWYVPNDGEHWNRLRNDAENLAHKGITSVWIPPVYKGTSQNDVGYGVYDVYDLGEFNQKGTIRTKYGTKAQLKSAIEALHNQNIDVYGDVVMNHKGGADYTEVVTAVEVDRNNRNIETSSDYQIDAWTGFDFPGRRDSYSNFKWRWFHFDGTDWDEGRKLNRIYKFKGVGKAWDWEVSSENGNYDYLMYADLDFDHPEVANEMKNWGTWYADELNLDGFRLDAVKHIDHEYLRDWVNHVRKQTGKEMFTVAEYWQNDIRTLNNYLGKVNYNQSVFDAPLHYNFHYASTGNGNYDMRNILKGTVVESHPTLAVTLVENHDSQPGQSLESVVSPWFKPLAYAFILTRAEGYPSVFYGDYYGTNGNSSYEIPTLKDKIDPILTARKNFAYGTQHDYLDHPDVIGWTREGDSIHANSGLATLISDGPGGSKWMNVGKNNAGEIWYDITGNQTNTVTINKDGWGQFHVNGGSVSIYVQK

SEQ ID NO: 167 - DNA, 1596 bp, Unknown
  Obtained from an environmental sample.
atgcaaacgattgcaaaaaaaggggatgaaacgatgaaagggaaaaaatggacagctttagctctaacactgccgctggctgctagcttatcaacaggcgttcacgccgaaaccgtacataaaggtaaatctccaacagcagataaaaacggtgtattttatgaggtgtatgtaaactctttttacgatgcaaataaagatggacatggtgatttaaaaggtcttacacaaaagttggattatttaaatgatggcaattctcatacaaagaatgatcttcaagtaaacgggatttggatgatgccggtcaacccttctcccagctatcataaatatgatgtaacggactattataatattgatccgcagtatggaaatctgcaagattttcgcaaactgatgaaagaagcagataaacgagatgtaaaagtcattatggacctcgttgtgaatcatacgagcagtgaacacccttggtttcaagctgcattaaaagataaaaacagcaagtacagagattactatatctgggctgataaaaataccgacttgaatgaaaaaggatcttggggacagcaagtatggcataaagccccaaacggagagtatttttacggaacgttttgggaaggaatgccggacttaaattacgataatcctgaagtaagaaaagaaatgattaacgtaggaaagttttggctaaagcaaggagttgacgggttccgtctagatgctgcgcttcatatttttaaaggccaaacacctgaaggcgctaagaaaaatctcctgtggtggaatgaatttagagatgcaatgaaaaaggaaaaccctaacgtatatctaacgggtgaagtatgggatcaaccggaagtagtagctccttactatcaatcgcttgattctttatttaactttgatttagcaggaaagattgtaaactctgtaaaatcaggaaatgatcaaggaatcgcgactgcagcagcggcaacggatgaactgttcaaatcatacaatccaaataaaattgacggtattttcttaaccaaccatgaccaaaatcgcgtcatgagtgagctaagcggcgatgtgaataaagcaaagtcagctgcctctatcttacttacgcttcctggcaacccgtatatttattacggtgaagaaatcggcatgaccggtgaaaagcctgatgagttaatccgtgaaccgttccgctggtacgaaggaaacggacttggacaaaccagctgggaaacacctgtatacaacaaaggcggcaacggcgtgtctgtagaagcacaaacaaaacaaaaggactctttgttaaatcattaccgtgaaatgattcgcgtgcgtcagcagcacgaagagttagtaaaaggaacgcttcaatctatttcagtagacagtaaagaagtcgttgcctatagccgcacgtataaaggcaaatcgattagcgtgtatcataatatttcaaatcaaccggtaaaagtatctgtagcagcaaaaggtaaattgatttttggtagtgaaaaaggtgctaagaaagtcaaaaatcagcttgtgattccggcgaatacaacggttttaataaaataa

SEQ ID NO: 168 - protein, 531 aa, Unknown
  Obtained from an environmental sample.
MQTIAKKGDETMKGKKWTALALTLPLAASLSTGVHAETVHKGKSPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVNSVKSGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGKSISVYHNISNQPVKVSVAAKGKLIFGSEKGAKKVKNQLVIPANTTVLIK

SEQ ID NO: 169 - DNA, 1524 bp, Unknown
  Obtained from an environmental sample.
atgaaaacattcaaattaaaacgcacttttttaccgctaaccttgctgctcagtgctcctgcctttgctgggcaaaatggcaccatgatgcagtattttcattggtatgtacctaatgatggcgcattatggacgcaggttgaaagcaatgctccagcactcgctgaaaacggttttacagcgctctggctaccgccagcttacaaaggcgcgggcggcagtaatgacgtcggttatggcgtctatgatatgtacgatttaggtgagtttgatcaaaaaggctcagtacgaaccaaatacggcaccaaggctcagtacatctctgcaatcaatgccgcgcacaacaacaatatccaaatctacggcgatgttgtgtttaaccaccgaggtggtgctgatgggaagtcgtgggtcgataccaagcgcgttgattgggacaaccgtaacattgaactgggcgacaaatggattgaagcttgggttgagtttaattttcctggccgcaacgacaaatactcaaacttccattggacttggtatcactttgacggtgttgactgggatgatgccggcaaagaaaaagcgatctttaaattcaaaggcgaaggaaaagcatgggattgggaagtcagctctgaaaaaggcaattacgactacctaatgtacgccgatttagacatggatcaccaagaagttaaacaagagctgaaagattggggtgagtggtacatcaacatgaccggcgttgatggctttagaatggatgccgtgaagcacattaaatatcagtatctacaagagtggattgatcatttacgttggaaaacaggcaaagagcttttcaccgttggtgagtattggaattacgacgtaaatcaactgcataactttattactaagacctctggcagtatgtcgttgttcgatgcgccgcttcacatgaacttctacaacgcgtcaaaatctggcggcaattacgatatgcgccaaatcatgaatggcacgttgatgaaggacaacccagtcaaagctgtgactctcgtagaaaaccacgatacacagccattgcaggcgttagagtcgacagtggattggtggttcaagcctcttgcttacgcattcattttattgcgtgaagaaggttatccatcagtgttctacgcagattactacggcgcgcagtacagcgacaaaggctacaacatcaatatggccaaagttccttacattgaagaacttgtaacactgcgtaaagagtatgcgtatggcaaacagaattcttatctcgaccactgggatgtgattggctggacccgagagggcgatgctgaacatccaaactcaatggcggtgatcatgagtgatggaccaggtggcaaaaaatggatgtataccggtaagccaagcacgcgctatgtcgacaagctgggtatccgaactgaagaagtttggaccgataccaatggctgggcagaatttcctgtcaatggtggttcagtctcggtttgggtgggcgttaagtaa

SEQ ID NO: 170 - protein, 507 aa, Unknown
  Obtained from an environmental sample.
MKTFKLKRTFLPLTLLLSAPAFAGQNGTMMQYFHWYVPNDGALWTQVESNAPALAENGFTALWLPPAYKGAGGSNDVGYGVYDMYDLGEFDQKGSVRTKYGTKAQYISAINAAHNNNIQIYGDVVFNHRGGADGKSWVDTKRVDWDNRNIELGDKWIEAWVEFNFPGRNDKYSNFHWTWYHFDGVDWDDAGKEKAIFKFKGEGKAWDWEVSSEKGNYDYLMYADLDMDHQEVKQELKDWGEWYINMTGVDGFRMDAVKHIKYQYLQEWIDHLRWKTGKELFTVGEYWNYDVNQLHNFITKTSGSMSLFDAPLHMNFYNASKSGGNYDMRQIMNGTLMKDNPVKAVTLVENHDTQPLQALESTVDWWFKPLAYAFILLREEGYPSVFYADYYGAQYSDKGYNINMAKVPYIEELVTLRKEYAYGKQNSYLDHWDVIGWTREGDAEHPNSMAVIMSDGPGGKKWMYTGKPSTRYVDKLGIRTEEVWTDTNGWAEFPVNGGSVSVWVGVK

SEQ ID NO: 171 - DNA, 1431 bp, Unknown
  Obtained from an environmental sample.
gtgtatgtaaactctttttacgatgcaaataaagatggacatggtgatttaaaaggtcttacacaaaagttggattatttaaatgatggcaattctcatacaaagaatgatcttcaagtaaacgggatttggatgatgccggtcaacccttctcccagctatcataaatatgatgtaacggactattataatattgatccgcagtatggaaatctgcaagattttcgcaaactgatgaaagaagcagataaacgagatgtaaaagtcattatggacctcgttgtgaatcatacgagcagtgaacacccttggtttcaagctgcattaaaagataaaaacagcaagtacagagattactatatctgggctgataaaaataccgacttgaatgaaaaaggatcttggggacagcaagtatggcataaagccccaaacggagagtatttttacggaacgttttgggaaggaatgccggacttaaattacgataatcctgaagtaagaaaagaaatgattaacgtaggaaagttttggctaaagcaaggagttgacgggttccgtctagatgctgcgcttcatatttttaaaggccaaacacctgaaggcgctaagaaaaatctcctgtggtggaatgaatttagagatgcaatgaaaaaggaaaaccctaacgtatatctaacgggtgaagtatgggatcaaccggaagtagtagctccttactatcaatcgcttgattctttatttaactttgatttagcaggaaagattgtaaactctgtaaaatcaggaaatgatcaaggaatcgcgactgcagcagcggcaacggatgaactgttcaaatcatacaatccaaataaaattgacggtattttcttaaccaaccatgaccaaaatcgcgtcatgagtgagctaagcggcgatgtgaataaagcaaagtcagctgcctctatcttacttacgcttcctggcaacccgtatatttattacggtgaagaaatcggcatgaccggtgaaaagcctgatgagttaatccgtgaaccgttccgctggtacgaaggaaacggacttggacaaaccagctgggaaacacctgtatacaacaaaggcggcaacggcgtgtctgtagaagcacaaacaaaacaaaaggactctttgttaaatcattaccgtgaaatgattcgcgtgcgtcagcagcacgaagagttagtaaaaggaacgcttcaatctatttcagtagacagtaaagaagtcgttgcctatagccgcacgtataaaggcaaatcgattagcgtgtatcataatatttcaaatcaaccggtaaaagtatctgtagcagcaaaaggtaaattgatttttggtagtgaaaaaggtgctaagaaagtcaaaaatcagcttgtgattccggcgaatacaacggttttaataaaataa

SEQ ID NO: 172 - protein, 476 aa, Unknown
  Obtained from an environmental sample.
VYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVNSVKSGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGKSISVYHNISNQPVKVSVAAKGKLIFGSEKGAKKVKNQLVIPANTTVLIK

SEQ ID NO: 173 - DNA, 1596 bp, Unknown
  Obtained from an environmental sample.
atgcaaacgattgcaaaaaaaggggatgaaacgatgaaagggaaaaaatggacagctttagctctaacactgccgctggctgctagcttatcaacaggcgttcacgcagaaactgtacataaaggtaaagctccaacagcagataaaaacggtgttttttatgaggtgtatgtaaactctttttacgatgcaaataaagatggacatggtgatttaaaaggtctgacacaaaagttggattatttaaatgacggcaattctcatacaaagaatgatcttcaagtaaacgggatttggatgatgccggtaaacccttctcctagctatcataaatatgatgtaacggactattataacattgatcctcagtacggaagtctgcaagatttccgcaaactgatgaaagaagcagataaacgagacgtaaaagttattatggaccttgttgtgaatcatacgagcagtgaacacccttggtttcaagctgcactaaaagataaaaacagcaagtacagagattactatatttgggctgataaaaataccgatttgaatgaaaaaggatcttggggacagcaagtatggcataaagctccaaacggagagtatttttacggaacgttctgggaaggaatgcctgacttaaattacgataaccctgaagtaagaaaagaaatgattaacgtcggaaagttttggctaaagcaaggcgttgatggcttccgcttagatgctgcccttcatatctttaaaggtcaaactcctgaaggcgctaagaaaaatctcctgtggtggaatgagtttagagatgcaatgaaaaaagaaaaccctaacgtatatctaacgggtgaagtatgggatcagccggaagtagtagctccttattatcaatcgcttgattccctatttaactttgatttagcaggaaaaattgtcagctctgtaaaagcaggaaatgatcaaggaatcgccactgcagcagcggcaacggatgagctgttcaaatcatacaatccaaataaaattgacggcattttcttaaccaaccatgaccaaaaccgcgtcatgagtgagctaagcggagatgtgaataaagcaaaatcagctgcttctatcttacttacgcttcctggaaatccgtatatttattacggtgaagaaattggcatgaccggtgaaaagcctgatgaattaatccgtgaaccgttccgctggtacgaaggcaacggaattggacaaactagctgggaaacacctgtatataacaaaggcggcaatggtgtgtctgtagaagcacaaaccaaacaaaaggattctttgttaaatcattaccgtgaaatgattcgcgtgcgtcagcagcacgaagagttagtaaaaggaacgcttcagtctatttcagtagacagtaaagaagttgtcgcttatagccgtacgtataaaggcaactccattagtgtgtatcataatatttcaaatcaacctgtaaaagtatctgtagcggcgaaaggtaaattgatttttgctagtgaaaaaggtgctaaaaaaggcaaaaatcagcttgtgattccggcgaatgcgacggttttaataaaataa

SEQ ID NO: 174 - protein, 531 aa, Unknown
  Obtained from an environmental sample.
MQTIAKKGDETMKGKKWTALALTLPLAASLSTGVHAETVHKGKAPTADKNGVFYEVYVNSFYDANKDGHGDLKGLTQKLDYLNDGNSHTKNDLQVNGIWMMPVNPSPSYHKYDVTDYYNIDPQYGSLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGIGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKGKNQLVIPANATVLIK

SEQ ID NO: 175 - DNA, 1398 bp, Unknown
  Obtained from an environmental sample.
atgaaaaatataatacgactttgtgctgccagcgctatcctcacggtgtcccacgccagttacgccgacgcaattttacacgcgtttaactggcaatataccgatgtaaccgccaatgcaaatcaaattgccgcaaatggctttaaaaaagtcctcatttcacccgcaatgaaatccagcggcagtcaatggtgggcccgctatcaaccgcaagacttgcgtgtcattgattctccgctgggcaacaaacaagatttagtcgcgatgatcaatgcgctcaacagcgttggggtcgacgtgtatgctgacgtggtgcttaaccatatggctaacgagtcatggaagcgcagtgacctgaactacccggggagtgaggtgctcaacgactatcaatcccgcagtgcttactatcaaaggcaaacacttttcggcaatttacaggagaaccttttttccgagaatgatttccatccggcaggctgtattaccaattggaatgatcctggccacgtccagtattggcgcttgtgcggcggacagggcgatactgggctaccggatctcgatcctaatcaatgggttgtgagtcagcagaagagttacttgaacgcactcaaatcaatgggaatcaaagggttccgtatcgatgcggtcaaacatatgagtcaatatcaaatagaccaagtgtttaccccagacattaccgctggtatgcatatattcggagaagtcattaccagtggtgggcaaggtgatagcggctatgaggcttttcttgccccttaccttaataataccgatcacgccgcttatgacttcccgctatttgcatcgattcgagccgcgttttcattctctggtgggttaaatcagctacacaatccacaagcctatggccaagcgttacaggactcacgtgcgatcacctttacgattacccacgacattccaaccaatgacggtttccgctaccagatcatggatccaaccgatgaacagctcgcctatgcctacatcttgggcaaagatggaggaacgccacttgtctatagtgatgacctacctgacagcgaagacaaagacagtggtcgttgggccgatgtgtggcaagatccgaacatgattaacatgcttgccttccacaacgcgatgcaaggacaaagcatgactgtagtggctagcgatcaatgtaccttgctatttaagcgcggcaagcaaggcgtggtaggaatcaataaatgtggcgagagtaagtcggtgactgtcgatacttaccagcatgagtttaactggtacaccccgtaccaagacgtattgagcggcgacatcaccacagtgagttctcgttatcaccaatttgttttgccagcgcgcagtgcaaggatgtggaaactataa

SEQ ID NO: 176 - protein, 465 aa, Unknown
  Obtained from an environmental sample.
MKNIIRLCAASAILTVSHASYADAILHAFNWQYTDVTANANQIAANGFKKVLISPAMKSSGSQWWARYQPQDLRVIDSPLGNKQDLVAMINALNSVGVDVYADVVLNHMANESWKRSDLNYPGSEVLNDYQSRSAYYQRQTLFGNLQENLFSENDFHPAGCITNWNDPGHVQYWRLCGGQGDTGLPDLDPNQWVVSQQKSYLNALKSMGIKGFRIDAVKHMSQYQIDQVFTPDITAGMHIFGEVITSGGQGDSGYEAFLAPYLNNTDHAAYDFPLFASIRAAFSFSGGLNQLHNPQAYGQALQDSRAITFTITHDIPTNDGFRYQIMDPTDEQLAYAYILGKDGGTPLVYSDDLPDSEDKDSGRWADVWQDPNMINMLAFHNAMQGQSMTVVASDQCTLLFKRGKQGVVGINKCGESKSVTVDTYQHEFNWYTPYQDVLSGDITTVSSRYHQFVLPARSARMWKL

SEQ ID NO: 177 - DNA, 1524 bp, Unknown
  Obtained from an environmental sample.
atgaaaacattcaaattaaaacgcacttttttaccgctgaccttgctgctcagtgctcctgcctttgctgggcaaaatggcaccatgatgcagtattttcattggtacgtacctaatgatggcgcattatggacgcaggttgaaagcaatgctccagtactcgctgaaaacggttttacagcgctctggctaccgcccgcatacaaaggcgcgggcggcagtaatgacgtcggttatggcgtctatgatatgtacgatttaggtgagtttgaccaaaaaggctcagtacgaaccaaatacggcaccaaggctcagtacatctctgcaatcaatgccgcgcacaacaacaatatccaaatttacggcgacgttgtgtttaaccaccgaggtggcgctgatgggaagtcgtgggtcgataccaagcgcgttgattgggacaaccgcaatattgaactgggcgacaaatggattgaagcttgggttgagtttaattttcctggccgcaacgacaaatactcgaacttccattggacttggtatcactttgacggtgttgactgggatgatgccggcaaagaaaaagcgatctttaaattcaaaggcgaaggaaaagcatgggattgggaagtcagctctgaaaaaggcaattacgactacctaatgtacgccgatttagacatggatcacccagaagttaaacaagagctgaaagattggggtgagtggtacatcaacatgaccggcgttgatggctttagaatggatgccgtgaagcacattaaatatcagtatctacaagagtggattgatcatttacgttggaaaacaggcaaagagcttttcaccgttggtgagtattggaattacgacgtaaatcaactgcacaactttattactaagacctctggcagtatgtcgttgttcgatgcgccgcttcacatgaatttctacaacgcgtcaaaatctggcggcacttacgatatgcgccaaatcatgaatggcacgttgatgaaggacaacccagtcaaagcagtgactctcgtagaaaaccacgatacgcagccattgcaggcgttagagtcgacagtagattggtggttcaagcctcttgcttacgcattcattttattgcgtgaagaaggttatccatcggtgttctacgcagattactacggcgcgcagtacagcgacaaaggttacaacattaatatggccaaagtgccttacattgaagaacttgtaacactgcgtaaagagtatgcgtatggcaaacagaattcttatctcgaccattgggatgtgattggctggacccgagagggcgatgctgaacatccaaactcaatggcggtgatcatgagtgatggaccgggcggcacaaaatggatgtataccggtaagccaagtacgcgctatgtcgacaagctgggtatccgaactgaagatgtttggaccgatgccaatggctgggcagaatttcctgtcaatggtggttcagtctcggtttgggtgggcgttaagtaa

SEQ ID NO: 178 - protein, 507 aa, Unknown
  Obtained from an environmental sample.
MKTFKLKRTFLPLTLLLSAPAFAGQNGTMMQYFHWYVPNDGALWTQVESNAPVLAENGFTALWLPPAYKGAGGSNDVGYGVYDMYDLGEFDQKGSVRTKYGTKAQYISAINAAHNNNIQIYGDVVFNHRGGADGKSWVDTKRVDWDNRNIELGDKWIEAWVEFNFPGRNDKYSNFHWTWYHFDGVDWDDAGKEKAIFKFKGEGKAWDWEVSSEKGNYDYLMYADLDMDHPEVKQELKDWGEWYINMTGVDGFRMDAVKHIKYQYLQEWIDHLRWKTGKELFTVGEYWNYDVNQLHNFITKTSGSMSLFDAPLHMNFYNASKSGGTYDMRQIMNGTLMKDNPVKAVTLVENHDTQPLQALESTVDWWFKPLAYAFILLREEGYPSVFYADYYGAQYSDKGYNINMAKVPYIEELVTLRKEYAYGKQNSYLDHWDVIGWTREGDAEHPNSMAVIMSDGPGGTKWMYTGKPSTRYVDKLGIRTEDVWTDANGWAEFPVNGGSVSVWVGVK

SEQ ID NO: 179 - DNA, 1524 bp, Unknown
  Obtained from an environmental sample.
atgaaaacattcaaattaaaacgcacttttttaccgctaaccttgctgctcagtgctcctgcctttgccgggcaaaatggcaccatgatgcagtactttcattggtacgtacctaatgatggcgcattatggacgcaggttgaaagcaatgctccagcactcgctgaaaacggttttacagcgctctggctaccgccagcttacaaaggcgcgggcggcagtaatgatgtcggttatggcgtctacgatatgtacgatttaggtgagtttgatcaaaaaggctcagtacgaaccaaatacggtaccaaggctcagtacatctctgcaatcaatgctgcgcacaacaacaatatccaaatttacggcgacgttgtgtttaaccatcgtggtggcgctgatgggaagtcgtgggtcgataccaagcgcgttgattgggacaaccgtaacattgaactgggcgacaaatggattgaagcttgggttgagtttaattttcctagccgcaacgacaaatactcgaacttccattggacttggtatcactttgacggtgttgactgggatgatgccggcaaagaaaaagcgatctttaaattcaaaggcgaaggaaaagcatgggattgggaagtcagctctgaaaaaggcaattacgactacctaatgtacgccgatttagacatggatcacccagaagttaaacaagagctgaaagattggggtgagtggtacatcaacatgaccggcgttgatggctttagaatggatgccgttaagcacattaaatatcagtatctacaagagtggattgatcatttacgttggaaaacaggcaaagagcttttcaccgttggtgagtattggaattacgacgtaaatcaactgcataactttattactaagacctctggcagtatgtcgttgttcgatgcgccgcttcacatgaacttctacaacgcgtcaaaatctggcggcaattacgatatgcgccaaatcatgaatggcacgttgatgaaggacaacccagtcaaagctgtgactctcgtagaaaaccacgatacgcagccattgcaggcgttagagtcgacagtggattggtggttcaagcctcttgcttacgcattcatcttgttgcgtgaagaaggttatccatcggtgttctacgcagattactacggcgcgcagtacagcgacaaaggttacaacattaatatggccaaagtgccttacattgaagaacttgtaacactgcgtaaagagtatgcgtatggcaaacagaattcttatctcgaccattgggatgtgattggctggactcgagagggcgatgctgaacatccaaactcaatggcggtgatcatgagtgatggaccgggcggaacaaaatggatgtataccggtaatccaagcacgcgctatgtcgacaagctgggtatccgaactgaagatgtttggaccgatgccaatggctgggcagaatttcctgtcaatggtggttcagtctcggtttgggtgggcgttaagtaa

SEQ ID NO: 180 - protein, 507 aa, Unknown
  Obtained from an environmental sample.
MKTFKLKRTFLPLTLLLSAPAFAGQNGTMMQYFHWYVPNDGALWTQVESNAPALAENGFTALWLPPAYKGAGGSNDVGYGVYDMYDLGEFDQKGSVRTKYGTKAQYISAINAAHNNNIQIYGDVVFNHRGGADGKSWVDTKRVDWDNRNIELGDKWIEAWVEFNFPSRNDKYSNFHWTWYHFDGVDWDDAGKEKAIFKFKGEGKAWDWEVSSEKGNYDYLMYADLDMDHPEVKQELKDWGEWYINMTGVDGFRMDAVKHIKYQYLQEWIDHLRWKTGKELFTVGEYWNYDVNQLHNFITKTSGSMSLFDAPLHMNFYNASKSGGNYDMRQIMNGTLMKDNPVKAVTLVENHDTQPLQALESTVDWWFKPLAYAFILLREEGYPSVFYADYYGAQYSDKGYNINMAKVPYIEELVTLRKEYAYGKQNSYLDHWDVIGWTREGDAEHPNSMAVIMSDGPGGTKWMYTGNPSTRYVDKLGIRTEDVWTDANGWAEFPVNGGSVSVWVGVK

SEQ ID NO: 181 - DNA, 1830 bp, Unknown
  Obtained from an environmental sample.
atgccagaggccttcggcctggccattacgccgtcacatagccggcgggggaggttggtgggcgtgtcgcgcgggggcagcctgccgatgccggtcctccactggccggcgttcatcctcgtccggcgcttcgtcgccggtcatccgaacaagcacaagaaccggagtattgcgatgagccacaccctgcgtgccgccgtattggcggcgatcctgctgccgttccccgccctcgctgaccaggccggcaagagcccggccggcgtgcgctaccacggcggcgacgaaatcatcctccagggcttccactggaacgtcgtccgcgaagcgcccaacgactggtacaacatccttcgccagcaggcctcgacgatcgccgcggacggcttctcggcaatctggatgccggtgccctggcgtgacttctccagctggaccgacggcggcaagtcaggcggcggcgaaggctacttctggcacgacttcaacaagaacggccgctacggcagcgacgcccagctgcgccaggccgccggcgcactcggtggcgccggggtgaaggtgctctacgatgtggtgcccaatcacatgaaccgcggctatccggacaaggagatcaacctgccggccggccagggcttctggcgcaacgactgcaccgacccgggcaactaccccaacgactgcgatgacggtgaccgcttcatcggcggcaagtcggacctgaacaccggccatccgcagatctacggcatgtttcgcgacgagcttgccaacctgcgcagcgggtacggcgccggcggcttccgcttcgacttcgttcgcggctatgcgcccgaacgggtcgacagctggatgagcgacagcgccgacagcagtttctgcgttggcgagctgtggaaaagcccgtccgagtacccgagctgggactggcgcaacacggcgagctggcagcagatcatcaaggactggtccgaccgggccaagtgcccggtgttcgacttcgcgctcaaggagcgcatgcagaacggctcggtcgccgactggaagcatggcctcaatggcaacccggacccgcgctggcgcgaggtggcggtgacctttgtcgacaaccacgacaccggctattcgcccgggcagaacggcggccagcaccactgggcgctgcaggacgggctgatccgccaggcctacgcctacatcctcaccagcccgggcacgccggtggtgtactggtcgcacatgtacgactggggctacggcgacttcattcgccagctgatccaggtgcggcgcaccgctggcgtgcgcgccgattcggcgatcagcttccacagcggctacagcggcctggtcgctaccgtcagcggcagccatcagaccctggtggtggcgctcaactccgatctggccaaccccggccaggtcgccagcggcagcttcagcgaggcggtcaacgccagcaacggccaggtgcgcgtctggcgcagcggtagcggcgatggcggcggcaatgacggcggcgagggcggtctggtcaatgtgaacttccgctgcgacaacggcgtgacgcagatgggcgacagcgtctacgcggtgggcaacgtcagccagctcggcaactggagcccggcctccgcggtacggctgaccgacaccagcagctatccgacctggaagggcagcatcgccctgcctgacggtcagaacgtggaatggaagtgcctgatccgtaacgaggcggacgcgacgctggtgcgccagtggcaatcgggcggcaacaaccaggtccaggccgctgccggcgcgagcaccagcggctcgttctga

SEQ ID NO: 182 - protein, 609 aa, Unknown
  Obtained from an environmental sample.
MPEAFGLAITPSHSRRGRLVGVSRGGSLPMPVLHWPAFILVRRFVAGHPNKHKNRSIAMSHTLRAAVLAAILLPFPALADQAGKSPAGVRYHGGDEIILQGFHWNVVREAPNDWYNILRQQASTIAADGFSAIWMPVPWRDFSSWTDGGKSGGGEGYFWHDFNKNGRYGSDAQLRQAAGALGGAGVKVLYDVVPNHMNRGYPDKEINLPAGQGFWRNDCTDPGNYPNDCDDGDRFIGGKSDLNTGHPQIYGMFRDELANLRSGYGAGGFRFDFVRGYAPERVDSWMSDSADSSFCVGELWKSPSEYPSWDWRNTASWQQIIKDWSDRAKCPVFDFALKERMQNGSVADWKHGLNGNPDPRWREVAVTFVDNHDTGYSPGQNGGQHHWALQDGLIRQAYAYILTSPGTPVVYWSHMYDWGYGDFIRQLIQVRRTAGVRADSAISFHSGYSGLVATVSGSHQTLVVALNSDLANPGQVASGSFSEAVNASNGQVRVWRSGSGDGGGNDGGEGGLVNVNFRCDNGVTQMGDSVYAVGNVSQLGNWSPASAVRLTDTSSYPTWKGSIALPDGQNVEWKCLIRNEADATLVRQWQSGGNNQVQAAAGASTSGSF

SEQ ID NO: 183 - DNA, 1596 bp, Unknown
  Obtained from an environmental sample.
atgcaaacgattgcaaaaaaaggggatgaaacgatgaaagggaaaaaatggacagctttagctctaacactgccgctggctgctagcttatcaacaggcgttcacgccgaaaccgtacataaaggtaagtctgaagcaacagataaaaacggtgtcttttatgaggtgtatgtaaactctttttacgatacaaataaagatggacatggtgatttaaaaggtctgacacaaaagttggattatttaaatgacggcaattctcatacaaagaatgatcttcaagtaaacgggatttggatgatgccagtcaacccttctcctagctatcataaatatgatgtaacggactattataacattgatcctcagtacggaaatctgcaagattttcgcaagctgatgaaagaagcagacaaacgagacgtaaaagtcattatggaccttgttgtgaatcatacgagcagcgaacacccttggtttcaagctgcattaaaagataaaaacagcaagtacagagattactatatttgggctgataaaaataccgatttgaatgaaaaaggatcttgggggcagcaagtatggcataaagctccaaacggagagtatttttacggaacgttttgggaaggaatgcctgacttaaattacgataaccctgaagtaagaaaagaaatgattaacgtcggaaagttttggctaaagcaaggcgttaatggcttccgcttagatgctgcgcttcatatttttaaaggtcaaacacctgaaggcgctaagaaaaatatcctgtggtggaatgagtttagagatgcgatgaaaaaagaaaaccctaacgtatatctaacgggtgaagtatgggatcagcctgaagtggtagctccttactatcaatcgcttgattctttatttaattttgatttagcaggaaaaattgtcagctctgtaaaagcaggaaatgatcaaggaatcgccactgcagcagcggcaacagatgaactgttcaaatcatacaatccaaataaaattgacggcattttcttaaccaaccatgaccaaaatcgcgtcatgagtgagctgagcggcgatgtgaacaaagcaaaatcagctgcttctatcttacttacgcttcctggcaacccgtatatttattacggtgaagaaattggcatgaccggtgaaaagcctgatgagttaatccgtgaaccattccgctggtacgaaggaaacggacttggacaaactagctgggaaacacctgtatataacaaaggcggcaacggcgtgtctgtagaagtacaaaccaaacaaaaggattctttgttaaatcattatcgtgaaatgattcgcgtgcgtcagcagcatgaagagttagtaaaaggaacgcttcaatctatttcagtagacagtaaagaagtggttgcctatagtcgcacgtataaaggcaactcgattagcgtgtatcataatatttcaaatcaacctgtaaaagtatctgtagcagcgaaaggtaaattgatttttgctagtgaaaaaggtgctaaaaaagtcaaaaatcagcttgtaattccggctaatacaacggttttaataaaataa

SEQ ID NO: 184 - protein, 531 aa, Unknown
  Obtained from an environmental sample.
MQTIAKKGDETMKGKKWTALALTLPLAASLSTGVHAETVHKGKSEATDKNGVFYEVYVNSFYDTNKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVNGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEVQTKQKDSLLNHYREMIRVRQQHEELVKGTLQSISVDSKEVVAYSRTYKGNSISVYHNISNQPVKVSVAAKGKLIFASEKGAKKVKNQLVIPANTTVLIK

SEQ ID NO: 185 - DNA, 1572 bp, Unknown
  Obtained from an environmental sample.
atgaaactgatgaaagggaaaaaatggacagctttagctctaacactgccgctggctgctagcttatcaacaggcgttcacgccgaaactgtacataaaggtaaagctccaacagcagataaaaacggtgtcttttatgaggtgtatgtaaactctttttacgatgcaaataaagatggacatggtgatttaaaaggtcttacacaaaagctggactatttaaatgacggaaattctcatacaaagaatgatcttcaagtaaacgggatttggatgatgccagtcaacccttctcctagctatcataaatatgatgtaacggattattataacattgatccgcagtacggaaatctgcaagattttcgcaagctgatgaaagaagcagacaaacgagacgtaaaagtcattatggaccttgttgtgaatcatacgagcagcgaacacccttggtttcaagctgcgttaaaagataaaaacagcaagtacagagattactatatttgggctgataaaaataccgacttgaatgaaaaaggatcttggggacagcaagtatggcataaagctccaaacggagagtatttttacggaacgttttgggaaggaatgcctgacttaaattacgataaccctgaagtaagaaaagaaatgattaacgtcggaaagttttggctaaagcaaggcgttgatggcttccgcttagatgctgcgcttcatatttttaaaggtcaaacgcctgaaggcgctaagaaaaatattctgtggtggaatgagtttagagatgcgatgaaaaaagaaaaccctaacgtatatctaacgggtgaagtatgggatcagcctgaagtggtagctccttactatcaatcgcttgattccctatttaactttgatttagcagggaaaattgtcagttctgtaaaagcaggaaatgatcaaggaatcgccactgcagcagcggcaacggatgagctgttcaaatcatacaatccaaataaaattgacggcattttcttaaccaaccatgaccaaaaccgcgtcatgagtgaactgatcggcgatgtgaacaaagcaaaatcagctgcttctatcttacttacgcttcctggcaacccgtatatttattacggtgaagaaattggcatgaccggtgaaaagcctgatgagttaatccgtgaaccgttccgctggtacgaaggaaacggacttggacaaaccagctgggaaacacctgtatataacaaaggcggcaacggcgtgtctgtagaagcacaaaccaaacaaaaggattctttgttaaatcattaccgtgaaatgattcgcgtgcgtcagcagcatgaagagttagtaaaaggaacgcttcaatctattttagtagacagtaaagaagttgttgcctatagccgtacgtataaagacaactcgattagcgtgtatcataatatttcaaatcaaccggtaaaagtatctgtagcagcaaaaggtaaattaatttttgctagtgaaaaaggtgctaaaaaagtcaagaatcagcttgtgattccggctaatacaacggttttaataaaataa

SEQ ID NO: 186 - protein, 523 aa, Unknown
  Obtained from an environmental sample.
MKLMKGKKWTALALTLPLAASLSTGVHAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELIGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSILVDSKEVVAYSRTYKDNSISVYHNISNQPVKVSVAAKGKLIFASEKGAKKVKNQLVIPANTTVLIK

SEQ ID NO: 187 - DNA, 2052 bp, Unknown
  Obtained from an environmental sample.
atgtatctcatccaggaggggcacatgcgttttccgcccattattcacccgcttaccggcctggccgttccggttggagctctgcgtaccgcacagagctgcggcataggggagtttgccgacttgccggttcttgccgaattctgcaaaaaagccggatttgatcttgtacagcttcttccggtcaatgacaccggcacagaaagttctccatacagcgcgctttctgcctttgccctgcacccgctgtatatcaggctttccgacctgcctgaagcagcgggtttcgaaaagcagattacagatctgaaaagccggtttgaggacttgcctcgtttcagctatacggagctgcgccgtgccaaactggatatcctgcgtgcagtgtttgataaaaacaaggcaaccatcatcggcagtgccgaactggaagcctggatttcagataacccctggatcatcgaatatgcggtttttatgaaccagaaacaccgcaactttgaagccggctggaaacattgggaaaagctgcgcaaccccactcataacgaaatacaaaaaacctggcagggtaaaacctggcaggctgaccatcaattctttgcatggctgcagatgcggctggaccagcagtttactgccgccgctacagagtgcaacgccctgggtgtctatcttaagggcgatatacctataatgatgaacgaggattccgcagatgcctgggcgaatccggaattcttccgtgacgatcttcgggccggaagtccccctgacggtgaaaacccccagggacaaaactggggcttccccatttataactgggaaaaccttgcaaatgacgggtacagctggtggaaaaaacgtctgaagcacagcgcacggtattaccatgcctaccgcattgaccatattcttgggtttttccggatatgggctataccctatggcgaatactccggctacctgggatggcccttgccgcatgaaccggtaagtgcagcagaactggcagaacggggcttttccaaggaccgcttgcgctggcttaccgaaccccacttgcctacacgggcagccgaggaagcgaataactgggactatctgggaacacacggctatctgaatcagatcatgaaccgtatcggtgaagaagaactatggctgttcaagcccgagatcacctgcgaggcagatatacgaaacacaaacctgccggatgccctgaaagaggttctggtacggcagtggaaaaaccggctgctgcaggttaccggccgcgacgaaaaaggacggacaatctactatccgctgtggcgtttccgtgacagcactgcatggcagacgcttaccgatggcgagaaacactccctggaagagctgttcgcccaaaaagcggcgcacaatgaaaccctgtggcgagaacaggcggtggaacttctgggtgagctgacgcgatctacggatatgcttgcctgtgctgaagatctgggaagtattccccacagtgtaccggaagtgctttcaaacctttcaatttacagtctgcgggttacccgctgggcccgccaatgggatgcccccggccagccctttcacagactggaggagtatccgctcatgtcggtagcgaccccatcggttcatgattcctctaccctgcgcggatggtgggaaaccgaaggcggcgaccgggcctttatggacgcatggcctccggaacaggatgcatacgcaggagcaggccgccatgagttcgaaggcgcctggggaccccgccaggcatcctgggtactccgtaaactctgcgaagcccgttccgcgctctgtgttttccccatccaggatattttggccctgtcttcagacttttatgcaatgacagcggacgaggaacgcatcaatattccgggcagtgtatccggatttaactggacataccggttgcctgcggcaatcgaggatttatctaaaaacagccaacttataaccgcaatccagaccgcgttgcaggaccgccgggcgaggaaggcacaaggagcacagcaatga

SEQ ID NO: 188 - protein, 683 aa, Unknown
  Obtained from an environmental sample.
MYLIQEGHMRFPPIIHPLTGLAVPVGALRTAQSCGIGEFADLPVLAEFCKKAGFDLVQLLPVNDTGTESSPYSALSAFALHPLYIRLSDLPEAAGFEKQITDLKSRFEDLPRFSYTELRRAKLDILRAVFDKNKATIIGSAELEAWISDNPWIIEYAVFMNQKHRNFEAGWKHWEKLRNPTHNEIQKTWQGKTWQADHQFFAWLQMRLDQQFTAAATECNALGVYLKGDIPIMMNEDSADAWANPEFFRDDLRAGSPPDGENPQGQNWGFPIYNWENLANDGYSWWKKRLKHSARYYHAYRIDHILGFFRIWAIPYGEYSGYLGWPLPHEPVSAAELAERGFSKDRLRWLTEPHLPTRAAEEANNWDYLGTHGYLNQIMNRIGEEELWLFKPEITCEADIRNTNLPDALKEVLVRQWKNRLLQVTGRDEKGRTIYYPLWRFRDSTAWQTLTDGEKHSLEELFAQKAAHNETLWREQAVELLGELTRSTDMLACAEDLGSIPHSVPEVLSNLSIYSLRVTRWARQWDAPGQPFHRLEEYPLMSVATPSVHDSSTLRGWWETEGGDRAFMDAWPPEQDAYAGAGRHEFEGAWGPRQASWVLRKLCEARSALCVFPIQDILALSSDFYAMTADEERINIPGSVSGFNWTYRLPAAIEDLSKNSQLITAIQTALQDRRARKAQGAQQ

SEQ ID NO: 189 - DNA, 1596 bp, Unknown
  Obtained from an environmental sample.
atgcaaacgattgcaaaaaaaggggatgaaacgatgaaagggaaaaaatggacagctttagctctaacactgccgctggctgctagcttatcaacaggcgttcacgccgaaaccgtacataaaggtaaatctccagctgcagataaaaacggtgtcttttatgaggtgtatgtaaactctttttacgatgcaaataaagatggacatggtgatttaaaaggtcttacacaaaaactggactatttaaatgatggcaattctcatacaaagaatgatcttcaagtaaacgggatttggatgatgccgatcaacccttctcctagctatcataaatatgatgtaacggactattataacattgattctcagtacggaaatctgcaagattttcgcaagctaatgaaagaagcagataaacgagatgtaaaagttattatggacctcgttgtgaatcatacgagcagtgaacacccttggtttcaagctgcgttaaaagataaaaacagcaagtacagagattactatatttgggctgataaaaataccgatttgaatgaaaaaggatcttggggacaacaagtatggcacaaagctccaaacggagagtatttttacggaacgttctgggaaggaatgcctgacttaaattacgataaccctgaagtaagaaaagaaatgattaacgtcggaaagttttggctaaagcaaggcgttgacggcttccgcttagatgctgcccttcatatctttaaaggtcaaacacctgaaggcgctaagaaaaatattgtgtggtggaatgaatttagagatgcgatgaaaaaagaaaacccgaacgtatatctaacgggcgaagtatgggatcagccggaagtggtagctccttattatcagtcgcttgattccctatttaactttgatttagcaggaaaaattgtcagctctgtaaaagcaggaaatgatcaaggaatcgctactgcagcagcggcaacagatgaactgttcaaatcatacaatccaaataaaattgacggcattttcttaaccaatcatgaccaaaatcgcgtcatgagtgagttaagcggagatgtcaataaagcaaagtcagctgcctctatcttacttacgcttcctggaaatccgtatatttattacggtgaagaaatcggcatgaccggtgaaaagcctgatgaattaatccgtgaaccgttccgctggtacgaaggaaacggacttggacaaactagttgggaaacacctgtatacaataaaggcggcaacggcgtgtctgtagaagcacaaaccaaacaaaaggactctttgttaaatcattaccgtgaaatgattcgcgtgcgtcagcagcacgaagagttagtaaaaggaacgcttcaatctatttcagtagacagtaaagaagttgttgcttatagccgtacgtataaaggcaactccattagtgtgtatcataatatttcaaatcaacctgtaaaagtatctgtagcagcgaaaggtaaattgatttttgctagtgaaaaaggtgctaaaaaggtcaaaaatcagcttgtgattccggcgaatacaacggttttagtaaaataa

SEQ ID NO: 190 - protein, 531 aa, Unknown
  Obtained from an environmental sample.
MQTIAKKGDETMKGKKWTALALTLPLAASLSTGVHAETVHKGKSPAADKNGVFYEVYVNSFYDANKDGHGDLKGLTQKLDYLNDGNSHTKNDLQVNGIWMMPINPSPSYHKYDVTDYYNIDSQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNIVWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKVKNQLVIPANTTVLVK

SEQ ID NO: 191 - DNA, 1596 bp, Unknown
  Obtained from an environmental sample.
atgcaaacgattgcaaaaaaaggggatgaaacgatgaaagggaaaaaatggacagctttagctctaacactgccgctggctgctagcttatcaacaggcgttcacgccgaaaccgtacataaaggtaaatctccaacagcagataaaaacggtgtcttttatgaagtgtatgtaaactctttttacgatgcaaataaagatggacatggtgacttaaaaggtcttacacaaaagttggactatttaaatgacggcaattctcatacaaaaaatgatcttcaagtaaacgggatttggatgatgccagtcaacccttctcctagctatcataaatatgatgtaacggactattataacattgatccgcagtacggaaatctgcaagattttcgcaagctgatgaaagaagcagacaaacgagacgtaaaagtcattatggaccttgttgtgaatcatacgagcagtgaacacccttggtttcaagctgcgttaaaagataaaaacagcaagtacagagattactatatttgggctgataaaaataccgacttgaatgaaaaaggatcttggggacaacaagtatggcataaagctccaaacggagagtatttttacggaacgttctgggaaggaatgcctgacttaaattacgataaccctgaagtaagaaaagaaatgattaacgtcggaaagttttggctaaagcaaggcgttgacgggttccgcttagatgctgcgcttcatatttttaaaggtcaaacagctgaaggcgctaagaaaaatatcctgtggtggaatgagtttagagatgcgatgaaaaaagaaaatccgaatgtatatctaacgggtgaagtatgggatcagcctgaagtggtagctccttattatcaatcgcttgattctttatttaattttgatttagcaggaaaaattgtcagctctgtaaaagcaggaaatgatcaaggaatcgccactgcagcagcagcaacagatgaactgttcaaatcatacaatccaaacaaaattgatggcatattcttaaccaaccatgaccaaaatcgcgtcatgagtgagctgagcggcgatgtgagcaaagcaaaatcagctgcttctatcttacttacgcttcctggcaacccgtatatttattacggtgaagaaatcggcatgaccggtgaaaagcctgatgaattaatccgtgaaccgttccgctggtacgaaggaaacggacttggacaaaccagttgggaaacacctgtatacaataaaggcggaaacggtgtgtctgtagaagcacaaaccaaacaaaaggattctttgttaaatcattaccgtgaaatgattcgcgtgcgtcagcagcatgaagagttagtaaaaggaacgcttcaatctatttcagtagacagtaaagaagttgttgcttatagccgtacgtataaaggcaactccattagtgtgtatcataatatttcaaatcaaccggtaaaagtatctgtagcagcgaaaggtaaattgatttttgctagtgaaaaaggtgctaagaaagtcaaaaatcagcttgtggttccggcgaatacaacggttttaatgaaataa

SEQ ID NO: 192 - protein, 531 aa, Unknown
  Obtained from an environmental sample.
MQTIAKKGDETMKGKKWTALALTLPLAASLSTGVHAETVHKGKSPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTAEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVSKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKVKNQLVVPANTTVLMK

SEQ ID NO: 193 - DNA, 1962 bp, Unknown
  Obtained from an environmental sample.
atgaaattcaaaaagagtttatctgccgggctccttttgttcggaggtctgagcggtgtgacaccatccgtcgctgcggaggtgccacgaaccgcatttgtccatttattcgaatggagttggccggatattgccaccgaatgcgaaacctttcttggccctaaggggttctctgcggttcaggtgtctccgccgcaaaaaagcgtcagcaatgctgcctggtgggcgcgctaccaacctgttagttactcttttgaagggcgcagtggaacccgggctcaatttgcggatatggtccagcgttgtaaagcggtgggggtcgatatttatctggatgcggtgatcaaccatatggcagcacaagatcgctattttccagaagtaccttacagcagtaatgattttcacagttgcacgggcgatatcgattattccaaccgctggtcgattcaaaattgcgatctggttgggctgaacgatctcaaaaccgagtcagaatacgttcggcagaaaattgcagactatatgaacgatgcgctcagtctgggcgtggcggggtttcggattgatgccgccaagcatatcccggccggcgacatcgcggcgatcaagagcaagctcaacggcagcccgtatatctatcaggaggttatcggggcggcaggggagccggtacaaaccagcgagtacacgtatattggagacgtgacggaatttaacttcgcccggaccatcgggcctaaatttaagcaaggtaatattaaagacctgcaggggattggttcgtggagcggctggctgagcagcgacgatgcggtgacctttgtgaccaaccatgacgaagaacgccataaccctggccaggttctcagccatcaggactttggcaatctgtatttcctcggtaacgtgtttactctggcgtatccttacggctacccaaaagtgatgtcggggtactacttcagtaattttgatgccgggccaccatcgacaggggtacattctggtaatgcgtgtggctttgatggcggtgattgggtctgcgaacacaaatggcgtggtgtagccaacatggtggcgtttcgcaaccacacagcagcccagtggcaggtcactgactggtgggacgatggttacaatcaggtggcgtttggtcgtggcgggctgggctttgtggtgatcaatcgagatgacaataaaggcatcaatcagagtttccagacgggaatgcccgctggcgagtattgtgacatcattgccggtgatttcgacacccagagcggtcattgcagcgctacgacgatcaccgtcgacagtcaggggtatgcacattttactgtcggtagtcatcaggccgctgcgattcacattggcgcgaaactcggctccgtgtgccaggactgtggcggcacggccgcagagacaaaagtctgctttgacaatgcacaaaactttagccaaccgtatttgcattactggaatgtcaatgcggatcaggccgtagcgaatgcaacctggccgggcgtcgcgatgacggctgaaaatggcggttactgctacgattttggtgtcggtctcaattcacttcaggtaattttcagcgataacggcgccagccaaaccgctgatctgaccgccagcagtccgacgttgtgttaccagaacggaacgtggcgtgacagtgacttctgtcagagtagcaatgtgggcaacgagagttggtatttccgtggaacctcaaacggttggggcgtgagcgcactcacttatgaggctgcgacaggcctgtacactacggtgcagagctttaacggggaggagtcgcccgcacgctttaaaattgatgatggcaactggagtgagtcgtatccaagtgctgattatcaagtcggtgattatgccacctacacgatcacgtttgacagccagacgaaggccatcaccgtgacttcgcagtaa

SEQ ID NO: 194 - protein, 653 aa, Unknown
  Obtained from an environmental sample.
MKFKKSLSAGLLLFGGLSGVTPSVAAEVPRTAFVHLFEWSWPDIATECETFLGPKGFSAVQVSPPQKSVSNAAWWARYQPVSYSFEGRSGTRAQFADMVQRCKAVGVDIYLDAVINHMAAQDRYFPEVPYSSNDFHSCTGDIDYSNRWSIQNCDLVGLNDLKTESEYVRQKIADYMNDALSLGVAGFRIDAAKHIPAGDIAAIKSKLNGSPYIYQEVIGAAGEPVQTSEYTYIGDVTEFNFARTIGPKFKQGNIKDLQGIGSWSGWLSSDDAVTFVTNHDEERHNPGQVLSHQDFGNLYFLGNVFTLAYPYGYPKVMSGYYFSNFDAGPPSTGVHSGNACGFDGGDWVCEHKWRGVANMVAFRNHTAAQWQVTDWWDDGYNQVAFGRGGLGFVVINRDDNKGINQSFQTGMPAGEYCDIIAGDFDTQSGHCSATTITVDSQGYAHFTVGSHQAAAIHIGAKLGSVCQDCGGTAAETKVCFDNAQNFSQPYLHYWNVNADQAVANATWPGVAMTAENGGYCYDFGVGLNSLQVIFSDNGASQTADLTASSPTLCYQNGTWRDSDFCQSSNVGNESWYFRGTSNGWGVSALTYEAATGLYTTVQSFNGEESPARFKIDDGNWSESYPSADYQVGDYATYTITFDSQTKAITVTSQ

SEQ ID NO: 195 - DNA, 2790 bp, Unknown
  Obtained from an environmental sample.
atgctgacagaccgtttctttgatggcgatacatcaaacaacgacccttacaaccagaactacgatgctaaaaacgaccggggaacttatcagggcggcgattttaaaggaatcacgcaaaaattggattatctcgataagctaggcgtgaacacaatctggatcagcccgatcgtggaaaatatcaagcatgatgtccgttatgacaactctgaagggcattcatactatgcttaccacggctactgggcaagcaacttcggtgcgttaaacccacacttcggtacaatggaagatttccatacactgattgacgctgcccatgaaaaaggcatcaagatcatggttgacgtagtattaaaccacactggttatggcttaaaagatatcaacggagaagtttccaatcctccagccggttacccaactgacgcagaacgcagcacatatagcagcctgcttcgccagggttcaaatgtcggctctgatgaggttgttggcgaattagctggcctacctgacttaaaaacagaagaccccgcagtccgccagacaatcatcgactggcaaacagactggatcacgaaagctactacagctaaaggaaacacaattgactacttccgtgtcgacactgtgaagcacgttgaagacgcaacatggatggcattcaaaaatgacctcactgaaaaaatgccgacacacaaaatgatcggggaagcttggggagcaagtgccaataaccaacttggataccttgaaacaggtatgatggactcactgcttgacttcgacttcaaaggcattgcgcacgatttcgtgaacggcaagcttaaggcagcaaacgatgccctgactgcccgcaacggtaaaattgacaacacagctactttaggttcattccttggaagccatgacgaagatggtttcctatttaaagaaggaaatgacaaaggcaagcttaaggttgctgcttccctgcaagcaacatcaaaaggccagccggtcatctattatggtgaagagcttggtcaaagtggagcaaacaactatccgcaatacgataaccgttatgacctggcatgggacaaagttgaaaacaacgacgtccttgagcactacactaaggtcctgaacttcagaagcgctcattcagaagtgttcgctaaaggtgaacgcgcaacaattggcggttctgacgctgataaattcttactttttgctcgtaaaaatggaaacgaagctgcttacgtcggcttgaacgttgctgacacagcaaaagacgtaacactgactgtttctgcaggtgcagtcgtaactgaccactatgcagataaaacttatactgcttcagaagctggagaaatcacattgacgatcccggcaaaagctgatggcggtactgttttactaacggttgaaggcggagaaatcacagctgctaaagcggcaagcgaaggcgacggcacagttgagccagtccctgcgaaccacatccgcattcactacaaccgtacagacaacaactatgaaaactacggtgcatggctgtggaacgatgtagcctccccttctgccaactggccgactggcgctacaatgtttgaaaaaacagacagctacggtgcatacatcgacgtaccacttaaagagggcgctaagaacatcggcttcctcgttatggatgtaacaaaaggtgatcagggtaaagacggcggcgacaaaggttttacgatctcatcacctgaaatgaacgaaatttggatcaagcaaggttctgacaaggtgtacacttacgagccagttgatcttccggcgaacactgtccgcgtccactatgtacgtgacaacgcagactacgaaaacttcggtatctggaactggggcgatgtaacagcaccttccgaaaactggcctacaggcgcagcgaaattcgatggtacagaccgttacggtgcgtatgtcgacattacgctaaaagaaggcgcaaagaacattggaatgattgctcttaacactgcaaatggagagaaagacggcggagataaatccttcaaccttctggataaatataatcgcatttggattaaacaaggtgatgacaatgtctacgtttctccatactgggagcaggcaacaggaatcaccaatgcagaggtaatctctgaagatacgattctattaggcttcacaatgactgacggcttaacacctgaatctttaaaaggaggtcttgtaattaaagattcaactggtgctgaagttgccatcgaaagtgctgaaatcacaagcgcaacctctgtaaaagtaaaagcaacattcgatttagaaaagcttccattatccatcacatacgcaggcagaacagtttcagcttcaactggctggagaatgcttgatgaaatgtacgcttatgatggaaacgaccttggtgcgacttacaaggacggagcagcgacgcttaaattatgggctccgaaagcgagcaaggtaaccgctaacttctttgataaaaataatgccgctgaaaaaatcggcagcgtcgagttaacgaagggtgaaaaaggagtctggtcagctatggttgctcctggcgacctgaacgtaaccgatcttgaaggttatttttaccagtatgatgtaacaaatgacggtataactcgccaggtgttagatccttatgcaaaatcaatggcagcctttactgtgaatacagaaggcaatgctggtcctgacggggacactgttggcaaggcggcaattcaaaaagcttctcgagagtacttctag

SEQ ID NO: 196 - protein, 929 aa, Unknown
  Obtained from an environmental sample.
MLTDRFFDGDTSNNDPYNQNYDAKNDRGTYQGGDFKGITQKLDYLDKLGVNTIWISPIVENIKHDVRYDNSEGHSYYAYHGYWASNFGALNPHFGTMEDFHTLIDAAHEKGIKIMVDVVLNHTGYGLKDINGEVSNPPAGYPTDAERSTYSSLLRQGSNVGSDEVVGELAGLPDLKTEDPAVRQTIIDWQTDWITKATTAKGNTIDYFRVDTVKHVEDATWMAFKNDLTEKMPTHKMIGEAWGASANNQLGYLETGMMDSLLDFDFKGIAHDFVNGKLKAANDALTARNGKIDNTATLGSFLGSHDEDGFLFKEGNDKGKLKVAASLQATSKGQPVIYYGEELGQSGANNYPQYDNRYDLAWDKVENNDVLEHYTKVLNFRSAHSEVFAKGERATIGGSDADKFLLFARKNGNEAAYVGLNVADTAKDVTLTVSAGAVVTDHYADKTYTASEAGEITLTIPAKADGGTVLLTVEGGEITAAKAASEGDGTVEPVPANHIRIHYNRTDNNYENYGAWLWNDVASPSANWPTGATMFEKTDSYGAYIDVPLKEGAKNIGFLVMDVTKGDQGKDGGDKGFTISSPEMNEIWIKQGSDKVYTYEPVDLPANTVRVHYVRDNADYENFGIWNWGDVTAPSENWPTGAAKFDGTDRYGAYVDITLKEGAKNIGMIALNTANGEKDGGDKSFNLLDKYNRIWIKQGDDNVYVSPYWEQATGITNAEVISEDTILLGFTMTDGLTPESLKGGLVIKDSTGAEVAIESAEITSATSVKVKATFDLEKLPLSITYAGRTVSASTGWRMLDEMYAYDGNDLGATYKDGAATLKLWAPKASKVTANFFDKNNAAEKIGSVELTKGEKGVWSAMVAPGDLNVTDLEGYFYQYDVTNDGITRQVLDPYAKSMAAFTVNTEGNAGPDGDTVGKAAIQKASREYF

SEQ ID NO: 197 - DNA, 1401 bp, Unknown
  Obtained from an environmental sample.
atgaaaccgtcaaaattcgtttttctctctgctgccatcgcttgcagcctctccagtaccgccaatgctgacgccattttgcatgcatttaactggaagtactccgacgtcacgcaaaacgcctcgcaaatcgcggcggcgggttataaaaaagtgctgatttcgccagcactgaaatcgagtggcaatgaatggtgggcacgttatcaaccgcaagatctgcgcgtgatcgattccccacttggcaacaaaagtgacttaaaatccatgattgatgctctgaaggcggtcggcgttgatgtgtatgccgatgtggtgcttaaccatatggccaatgaaacatggaagcgtgaagacttaaattaccctggcagtgaagtgctgcaacaatacgcagctaacaccagttattatgcggaccaaacgctttttggcaatttaacggaaaacctattctctggctttgacttccacccagaaggctgtattagcgattggaatgatgccggcaatgttcagtactggcgtctttgtggcggtgctggtgaccgagggctgccagacttagatccgaacaactgggtggtgtcacagcaacgtttgtatttgaatgcgctaaaaggtttaggtgtgaaaggcttccgcattgatgcggttaaacacatgagccaatatcaaatcgaccagattttcactgcagagattaccgccggaatgcacgtgtttggtgaagtgatcaccagtggtggcaaaggcgactccagctatgagaacttcttagcgccttatctcaacgccaccaaccattcggcttacgatttcccactgtttgcctctattcgcaacgccttctcctacagcggtggcatgaacatgcttcatgatccacaagcctatggccaagggcttgaaaacgcacgttcaattacctttaccatcacgcacgacatcccaacgaacgacggtttccgttatcaaatcatggatccgaaagatgaagagctggcttacgcttatatcctcggtaaagatggcggcacacctctgatttacagcgacaacttacctgataacgaagatcgtgataatcgccgttgggaaggtgtttggaaccgtgacctgatgaagaacatgttgcgcttccataaccaaatgcaagggcaagagatgacgatgctgtacagcgaccaatgtctactgatgtttaagcgcggtaaacaaggggtggtcggcattaataaatgcggtgaagagcgttctcataccgttgacacctatcagcatgagttcaactggtatcagccttacacagatacactcactggcgtgactgaaaccgtgagttcgcgttaccacaccttccgaattccagctcgcagcgcgcgcatgtacatgctctaa

SEQ ID NO: 198 - protein, 466 aa, Unknown
  Obtained from an environmental sample.
MKPSKFVFLSAAIACSLSSTANADAILHAFNWKYSDVTQNASQIAAAGYKKVLISPALKSSGNEWWARYQPQDLRVIDSPLGNKSDLKSMIDALKAVGVDVYADVVLNHMANETWKREDLNYPGSEVLQQYAANTSYYADQTLFGNLTENLFSGFDFHPEGCISDWNDAGNVQYWRLCGGAGDRGLPDLDPNNWVVSQQRLYLNALKGLGVKGFRIDAVKHMSQYQIDQIFTAEITAGMHVFGEVITSGGKGDSSYENFLAPYLNATNHSAYDFPLFASIRNAFSYSGGMNMLHDPQAYGQGLENARSITFTITHDIPTNDGFRYQIMDPKDEELAYAYILGKDGGTPLIYSDNLPDNEDRDNRRWEGVWNRDLMKNMLRFHNQMQGQEMTMLYSDQCLLMFKRGKQGVVGINKCGEERSHTVDTYQHEFNWYQPYTDTLTGVTETVSSRYHTFRIPARSARMYML

SEQ ID NO: 199 - DNA, 399 bp, Unknown
  Obtained from an environmental sample.
gtgagtttgaccaaaaaggctcagtacgaaccaaatacggcaccaaggctcagtacatctctgcaatcaatgccgcgcacaacaacaatatccaaatttacggcgatgttgtgtttaaccaccgaggtggtgctgatgggaagtcgtgggtcgataccaagcgcgttgattgggacaaccgcaatattgaactgggcgacaaatggattgaagcttgggttgagtttaattttcctggccgcaacgacaaatactcgaacttccattggacttggtatcactttgacggtgttgactgggatgacgccggcaaagaaaaagcgatctttaaattcaaaggcgaaggaaaagcatgggattgggaagtcagctctgaaaaaggcaattacgactacctaa

SEQ ID NO: 200 - protein, 132 aa, Unknown
  Obtained from an environmental sample.
VSLTKKAQYEPNTAPRLSTSLQSMPRTTTISKFTAMLCLTTEVVLMGSRGSIPSALIGTTAILNWATNGLKLGLSLIFLAATTNTRTSIGLGITLTVLTGMTPAKKKRSLNSKAKEKHGIGKSALKKAITTT

SEQ ID NO: 201 - DNA, 1911 bp, Unknown
  Obtained from an environmental sample.
atgacagccaaggctgatgacttacgcatttaccagatcatggtggaaagctttgtggatggcgataaacaggtcggccatggcaccggctacggtaccagccatcacaaaggcgatctgcaagggatcattgactcgctggattacattcaatcgctgggcgtcaatgccatttggctaacgccgatttttgaatctattccggtggagggacaagaccattgggcggacaggcttgatgctacaggctactttgccagtgactatttcaagatagaccctcgctttggcacgttagaacaagcccgtgagctggtggaaaaggcacacgcgaaaggcttgtatgtcttctttgatggagtatttggtcaccataaaggcaatgtggtgccatcaccacaaggtagactgcctgtcggtgaaaataacccggtcagctacccagagagcctggcgttttacgaagaagtcgccagttactgggtgaaagagttaaagattgatggctggcgtctggatcaagcctatcaagtgccgaccgatgcatggaaagcgatccgtcagagcgttgatgaagcgtcacagtccgtaacttatgtgaataacaaaggggaaaccgtccatcctttgggttacatggtggctgaaatttggaataacgaacgttacatcacagaaaccggttacggcaaagaaggcgatccggcgttgtgctcggcttttgattttccgatgcgtttccgagtggtcgaaacctttgcggttaacgaaagtggtgtcagccgaaaaggcggcgaatggttgaatgacggcatgtcactgcacagtcagtatccggatcatgccaagcctaatttaatgttgggcaaccatgatgtggtgcgctttggggatctgctgcaacgtggcggtattgcgtcaccagaacaaccgcaatactggcagcgtcataaagcggcgatgtctttcttagcagcgtataccggcccaattaccttgtattacggtgaagaaattggcgatcaggttgacggctttgctaaaaaaatcaaagaagattgtgccgttattggtttgtgtgatgaccacgtggcgcgcaccagtgcgaagattgatggcgtgacggcgtcactgaatgcacagcagtctgaactcaaagtatatgtctcttcattgatgacattacgtcagcaacatcctgcgttatcacaaggggaacgtactaatgtgatggcgacagagacagtatacgtagaccataaacaggcagacaatgaagccctgttgtacatggtgagtacgactgataacgcggagtcagtcaccttgaagggcaaagcgattggttcacaaggtgtgctgattgatttgttaacgaacgagcgttttatgcccaataatggggagtatgccattccattaacgggctttggcgcacgattcctcaagattgacactccgacagcggcgggtgtgatggcgcaatctgctgcctcggtatcgctagtaggtgaagggatcatggcccaatgtgataccccaaccgttgaaggcaccggtccggtagcagaaaccttgtacgtggttggcgattttgccgatgctggttggaagcaaaagccgcagcgcgcgtatcaatacaaaggcaagcacaatggcagcaacttgtatcaagtggttgtcgatgaaaaagcgggcgcctacaagatgcaatacgccacgaaagattggagcccacagtttactgcagacggtatggcattgaagccgggtaccgcaaagtcgctcatagcgggtggctacggtaaagacaccgccgtgacgttgccggaatccggtaagtatgtgtggagcttaacattcagtgatcttggcgagccggagcaaatcatggtgtctaagtgtcagtaa

SEQ ID NO: 202 - protein, 630 aa, Unknown
  Obtained from an environmental sample.
MTAKADDLRIYQIMVESFVDGDKQVGHGTGYGTSHHKGDLQGIIDSLDYIQSLGVNAIWLTPIFESIPVEGQDHWADRLDATGYFASDYFKIDPRFGTLEQARELVEKAHAKGLYVFFDGVFGHHKGNVVPSPQGRLPVGENNPVSYPESLAFYEEVASYWVKELKIDGWRLDQAYQVPTDAWKAIRQSVDEASQSVTYVNNKGETVHPLGYMVAEIWNNERYITETGYGKEGDPALCSAFDFPMRFRVVETFAVNESGVSRKGGEWLNDGMSLHSQYPDHAKPNLMLGNHDVVRFGDLLQRGGIASPEQPQYWQRHKAAMSFLAAYTGPITLYYGEEIGDQVDGFAKKIKEDCAVIGLCDDHVARTSAKIDGVTASLNAQQSELKVYVSSLMTLRQQHPALSQGERTNVMATETVYVDHKQADNEALLYMVSTTDNAESVTLKGKAIGSQGVLIDLLTNERFMPNNGEYAIPLTGFGARFLKIDTPTAAGVMAQSAASVSLVGEGIMAQCDTPTVEGTGPVAETLYVVGDFADAGWKQKPQRAYQYKGKHNGSNLYQVVVDEKAGAYKMQYATKDWSPQFTADGMALKPGTAKSLIAGGYGKDTAVTLPESGKYVWSLTFSDLGEPEQI

SEQ ID NO: 203 - DNA, 2601 bp, Unknown
  Obtained from an environmental sample.
atgaagatgaagtcccgggcgtggttgttaggtagtgcagtggccatggcgttggcctcttcggcagccaatgccggtgtcatggttcacctgttccagtggaagtacaatgacatcgccaacgagtgcgaaaaggtgctcggtcccaaagggtatgaagcagtgcagatcacgccgcctgctgaacacctgcaaggctcctcctggtgggtggtctatcagcccgtcagctacaagaacttcacttctctgggcggtaacgaggccgaactcaaaagcatgatcgcccgttgcaaggccgccggggtcaagatttacgccgatgcggtattcaaccagctggctggtggatcaggcgtcggtacaggtggtagcagctacaatgccggcagcttcagctatccccaatttggctacaacgatttccatcacgctgggagcctcaccaactatgccgaccgcaacaatgtgcaaaacggtgccctgctggggctgccggatctggataccggctctgcctatgtgcaggatcagctggctacctatatgaagaccctgagtggctggggtgtggcaggttttcgtcttgatgcagcaaagcatatgagcgttgccgatctctcggccatcgtcagcaaggcgggcaatccttttgtctactccgaggtgattggtgccacgggtgaaccaatccagccgggcgaatataccggcattggtgccgtgaccgaatttaaatacggcaccgatctggcctccaacttcaaggggcagatcaagaatctcaagagcatgggcgagagctggggtctgcttgcgtcgaacaaggctgaagtctttgtggtcaaccatgaccgtgagcggggacatggcggtggcggtatgctgacctacaaggatggtgccctctacaatctggccaacatcttcatgctggcctggccctatggcgcctatccccaggtgatgtccggctatgatttcggcaccaataccgatattggtgggccgagcgctaccccttgttcttccggctctagctggaactgcgaacaccgctggagcaacatcgccaacatggtctcgttccacaatgccgcccaaggcacgtccatgaccaactggtgggataatggtaataaccagatcgcctttggtcgcggcgccaaggcctttgtggtgatcaacaatgaatcttccactctgagcaagagcctgcagacgggtctgccagccggggagtactgcaacattctggccggtgatgccctgtgcagcggcagcaccatcaaggtggatgccagcggtatggccaccttcaacgtggcagggatgaaggcggcagcgatccatatcaatgccaagcccgatagcaccagcagtggcagctcaggctcttcctctggctcttcttcctctgccaccagtaacaagtttgccagcatgaatctgcggggcaccaacaatggctgggccagcaccgccatgacagtggatgccaaccgtgtctggtcggcggatgtcacctttaccggggccgcggatgccaatggtgcccagcgcttcaagtttgatgtctatggcaactggacagagagctatggcgatacacaagccgatggcattgccgacaaggggagcgccaaggacatctatttcaatggtgtgggcaagtatcgtgtctcgctcaaggagagcgacatgagctacaccctgacccagctctccagcaatcaggcaccggtggcggccatcacccccaagacactctccgtcaagctgggtgactcagtggtgttcgatgcctccggctccaccgatgatgtgggtgtcactggctacagctggtctaccggtggcagtgccaagaccgaaactgtgctgtttgatgctctgggtaccaagaccattaccgtgacagtggccgatgccgatggcttgacctccaaggccagtgccaccgtcaccgtcaccgatggcagcgtggcttataacagcaactttgccagcctgaacttccgtggcactcccaacagttggggcgcggcagccatgacgctggtggcagacaacacctgggaggcaacggtcaacttcgatggtcaggccaatcagcgcttcaagttcgatatcaagggtgactggagccagaactatggtgatagcaacaaggatggggtggccgaacgtaccggtgccgatatttacaccactgtgaccggtcaatataaggtgcaatttaacgactccactttgaagtacaccctgaccaagctggccgatagcagcgccaccagctatagcgcgaactttgccagcctctacctgcgtggcaccccgaacagctggggcaccaccgccatgaagctggtggccaataacagctggcaggccgaggtgaccttcaccggcaagggcgatgccactggtgcccaacgcttcaagttcgacgtcaagggtgactggagccagaactacggtgacagcaacatggacgggactgccgaacggactggtggcgatatcaccagtgccgtggtgggcacctatctggtgacctttaatgacagcacactgaaatacaccctgaccgccaaataa

SEQ ID NO: 204 - protein, 866 aa, Unknown
  Obtained from an environmental sample.
MKMKSRAWLLGSAVAMALASSAANAGVMVHLFQWKYNDIANECEKVLGPKGYEAVQITPPAEHLQGSSWWVVYQPVSYKNFTSLGGNEAELKSMIARCKAAGVKIYADAVFNQLAGGSGVGTGGSSYNAGSFSYPQFGYNDFHHAGSLTNYADRNNVQNGALLGLPDLDTGSAYVQDQLATYMKTLSGWGVAGFRLDAAKHMSVADLSAIVSKAGNPFVYSEVIGATGEPIQPGEYTGIGAVTEFKYGTDLASNFKGQIKNLKSMGESWGLLASNKAEVFVVNHDRERGHGGGGMLTYKDGALYNLANIFMLAWPYGAYPQVMSGYDFGTNTDIGGPSATPCSSGSSWNCEHRWSNIANMVSFHNAAQGTSMTNWWDNGNNQIAFGRGAKAFVVINNESSTLSKSLQTGLPAGEYCNILAGDALCSGSTIKVDASGMATFNVAGMKAAAIHINAKPDSTSSGSSGSSSGSSSSATSNKFASMNLRGTNNGWASTAMTVDANRVWSADVTFTGAADANGAQRFKFDVYGNWTESYGDTQADGIADKGSAKDIYFNGVGKYRVSLKESDMSYTLTQLSSNQAPVAAITPKTLSVKLGDSVVFDASGSTDDVGVTGYSWSTGGSAKTETVLFDALGTKTITVTVADADGLTSKASATVTVTDGSVAYNSNFASLNFRGTPNSWGAAAMTLVADNTWEATVNFDGQANQRFKFDIKGDWSQNYGDSNKDGVAERTGADIYTTVTGQYKVQFNDSTLKYTLTKLADSSATSYSANFASLYLRGTPNSWGTTAMKLVANNSWQAEVTFTGKGDATGAQRFKFDVKGDWSQNYGDSNMDGTAERTGGDITSAVVGTYLVTFNDSTLKYTLTAK

SEQ ID NO: 205 - DNA, 1674 bp, Unknown
  Obtained from an environmental sample.
atgtaccgcgtaatacctattattttgattatgagtatgattgtagcttgtgagtctccaaagaaaaaaacaaccgaaaccgctcaaccttcaacaaatgccgaaaaaccctttgtttgggaggctgccaatgtatattttttgttaactgaccgttttaacaacggtaacccaaacaatgacatcaattttaataggactaaagaatcaggaaaactccgcaattttatgggaggcgatatcaagggcatcacccaaaaaataaatgaggggtattttagtaaactaggcgttaatgccatctggcttaccccggttgttgaacaaatacatggcagtgttgatgaaggtaccggcaatacctatgcctttcatggctattgggccaaagattggacaaacttagacccaaattttggcacaaaagaagaccttgccgaactggtggcaactgcccatgcaaaaggcatcaggatacttttagatgtggtaataaaccacaccggcccggtaaccgaccaagacccggtttggggagaagattgggtacgtacaggcccgcagtgtacctatgataattacaccaataccaccagttgcacgctggtagccaatttacctgatatacttacagaaagtaatgaaaatgtggccttaccaacctttttgttagataaatggaaagccgaaggcagattagagcaagaactaaaagaacttgacgattttttttcccgcacaggccacccacgcgcaccccgcttttacattattaaatggcttaccgattacatccgagaatttggggtagatgggtttagggttgataccgtaaaacataccgaagaaacggtttgggccgagttgtatgatgaagccgtaattgcttttgccgaatataaaaaagccaacccagacaaggtattggacgataatgaattttatatggtaggcgaagtgtacaactacggtatttccggcggaaggttctatgatttcggcgataaaaaggtggactattttgaccacggatttaaaagcctcatcaattttgaaatgaaatatgatgccaattttacctacgatacactttttaggaagtacgatacccttttgcataccaaacttaaaggcagaagtgtgctcaactacctctcatctcacgacgatggaagtccatttgataaaatgcggcaaaaaccatacgagtcggctacaaaattactgctcactccgggcgcatcccaaatttattacggtgacgaaaccgccagaagccttaacatagaaggcgcacagggagatgctacgcttcgttcgtttatgaattgggaagagctcgcagaagaccctgccaagcaaaaaatacttcagcattggcaaaaactgggcagtttcaggaacaaccaccccgcagttggtgccggaaggcacaaaacccttggcaaaaagccgttttacacctttagcagggtttatcaaaaaaatggttttattgacaaagttgtggtagcattagatgcccctaaaggccaaaaacaaattaccgttaatggtgtttttgatgacggtacaaaacttgtagatgcctattcaggcaaagaaacctcagttaaaaatggtatcgtttcactttcttctgaatttgatattgttttgttagaacaaaaataa

SEQ ID NO: 206 - protein, 557 aa, Unknown
  Obtained from an environmental sample.
MYRVIPIILIMSMIVACESPKKKTTETAQPSTNAEKPFVWEAANVYFLLTDRFNNGNPNNDINFNRTKESGKLRNFMGGDIKGITQKINEGYFSKLGVNAIWLTPVVEQIHGSVDEGTGNTYAFHGYWAKDWTNLDPNFGTKEDLAELVATAHAKGIRILLDVVINHTGPVTDQDPVWGEDWVRTGPQCTYDNYTNTTSCTLVANLPDILTESNENVALPTFLLDKWKAEGRLEQELKELDDFFSRTGHPRAPRFYIIKWLTDYIREFGVDGFRVDTVKHTEETVWAELYDEAVIAFAEYKKANPDKVLDDNEFYMVGEVYNYGISGGRFYDFGDKKVDYFDHGFKSLINFEMKYDANFTYDTLFRKYDTLLHTKLKGRSVLNYLSSHDDGSPFDKMRQKPYESATKLLLTPGASQIYYGDETARSLNIEGAQGDATLRSFMNWEELAEDPAKQKILQHWQKLGSFRNNHPAVGAGRHKTLGKKPFYTFSRVYQKNGFIDKVVVALDAPKGQKQITVNGVFDDGTKLVDAYSGKETSVKNGIVSLSSEFDIVLLEQK

SEQ ID NO: 207 - DNA, 1378 bp, Unknown
  Obtained from an environmental sample.
ctgtcgactgagcctttcgttttgggctcgagactgactctcagcccaccccgcagtagctccagacggagtagccgtaatagccgttggccgggtcgtgggcaggggcctcgaggtacacccacccgcttgagtccacccacttgtccacccagccgccgaggttgccggtgtactcgtggatgcacgctcccgcgaacttcggaacgtagacccaccttccggctttgcttgaggcgaggttgatgtatgttatcagtcccggcttgcttccgtagccgtttctcacgaatatcagctcgtcgttgtcgtagtaaacgacgtcagtgcttcctccggccaggttgtcatgtatccagatgaggttcttgagcttatccttgttgagccactcctcgtagtcgcggtagaatattgtcggctggccctcgtaggtgaggatgaacgcgtaggctggatacttgttccagattatatcggtgtcgtggtttgcaacgaaggttacggccttaaacgggtcgcggctgacgactgtgcccccgttcttgagggcctcgacgagtgcgggaatgttcttgttgtcaaaggccgcgtccatcttgtagtagagcgggaagtcgaagaccttggcgccgctcgagtaggcccagttgaggagtgcatcaacgttggtgtcccagtactcgccaacggcccagccgccccaccagttgagccagtccttgacgacccacgctccgtggcccttcacgtagtcaaagcgccaggcatcaacgccgatgctccttaggtaggcggcgtagctctcatcgctcgcccagagccagtgctggtcccagctcttctcgtgggctatgtctgggaagcctccaaatgtgccctcgtcacagcacttgacctcgttggggtggaagtcgaggtagttggcagtatatttgcccgaggccacctttgagaagtccgtccaggtgtagtccccaacgaacgggttccactcgaggtctccgcctgcgcggtggtttatgacgatgtccgctatgacctttatgccgtaggcatgggccgtgtttatcatgttcacgagctcctgcttggagccaaagcgcgtctctaccgttcccttctggtcgtactcaccgaggtcaaagaagtcgtaggggtcgtagcccatcgaataggcgccgcccatgcccttgctcgccgggggaatccaaatggcggatattcccgcctcgtaccactccggtatcttgctcctgatggtgtcccaccagattcctccacctgggacgtcccagtagaaggcctgcattataacgccgccctcttccagctcggagtacttggccataagttacctcctactagtagattaaaa

SEQ ID NO: 208 - protein, 439 aa, Unknown
  Obtained from an environmental sample.
LSTEPFVLGSRLTLSPPRSSSRRSSRNSRWPGRGQGPRGTPTRLSPPTCPPSRRGCRCTRGCTLPRTSERRPTFRLCLRRGCMLSVPACFRSRFSRISARRCRSKRRQCFLRPGCHVSRGSAYPCATPRSRGRILSAGPRRGTRRLDTCSRLYRCRGLQRRLRPTGRGRLCPRSGPRRVRECSCCQRPRPSCSRAGSRRPWRRSSRPSGVHQRWCPSTRQRPSRPTSASPRPTLRGPSRSQSARHQRRCSLGRRRSSHRSPRASAGPSSSRGLCLGSLQMCPRHSTPRWGGSRGSWQYICPRPPLRSPSRCSPQRTGSTRGLRLRGGLRCPLPLCRRHGPCLSCSRAPAWSQSASLPFPSGRTHRGQRSRRGRSPSNRRRPCPCSPGESKWRIFPPRTTPVSCSWCPTRFLHLGRPSRRPALRRPLPARSTWPVTSYIK

SEQ ID NO: 209 - DNA, 1416 bp, Unknown
  Obtained from an environmental sample.
atgattcagcccatgcactctcgggaacaggcctgccgtctcattccggcactgatcatgacatttgcactggcactgccgttgcaaattcgtgccgatgtcaccctgcatgctttcaactggagctatgccgatgtcgctgatcgggccgttgacatcgctgcagcagggtacagtgccgtgctggtggccccgccacttcgatccgaaggcacggcctggtgggcgcgataccagccccaggatctccgccttatcgaccatccgctgggcaatacacatgacttcgtcaacatgatcgatgctctcgatgatgtgggtgtgggcgtgtacgccgacatcgtgctcaaccacatggccaatgaggctgcacaaaggcctgacctgaactaccctggtcaggcagtgcttgacgaatatgcttccgatcccggtcatttcgagggcttgaggctgttcggtaatctgagcttcaatttcctgtcggaacatgatttcggacccgcccagtgcattcaggattacagcgatgtgtttcaggtccagaactggcggctgtgcggaccgccgccggacccgggcctgcccgacctggtcgccaatgactgggtgatctctcaacagcgccagtatctggaagccatcaaggcgctgggtgtggctggcatgcgcatcgacgcggtcaagcatatgcccatgagccatatcaatgccgttctcacccccgagatccggtcgggcttgcatgtgtttggcgaagtcatcacctccggtggggctggtgatacatcctacgaccgttttctggccccttacctggcacaaagcgaccatggtgcctatgactttccattgtttgaaaccattcgccgtgctttcggcttcggtggcagcatgagtgaactggtcgatcctgctgcctacggtcaggccctgccaccggaccgcgccatcaccttcgtcatcacgcacgatattccgaacaatgacggatttcgctaccagatactcgaccccgtcgatgaatcactggcctacgcctacattctgggccgcgatggcggtgtcccgcttctgtattccgacaacaatgaaagcggcgatggccgctggatcgatgcctggcaacgtccggatctggttgcaatggtcggcttccacaatgcagtccacggtcaggacatggccgtgctttcacatgacgactgccacctgctgtttcggcgcggcagcctcgggattgtcggcatcaacaagtgcggccatgcactcagctcctgggtcaacatgaaccagagcgtactgtggtggtacgcggactacacagacgtgctcgacagcaacagcgttgtcaacatccagtcatcctggcacgagttcatccttcccgcccgccaggcacgcctgtggttgcga

SEQ ID NO: 210 - protein, 472 aa, Unknown
  Obtained from an environmental sample.
MIQPMHSREQACRLIPALIMTFALALPLQIRADVTLHAFNWSYADVADRAVDIAAAGYSAVLVAPPLRSEGTAWWARYQPQDLRLIDHPLGNTHDFVNMIDALDDVGVGVYADIVLNHMANEAAQRPDLNYPGQAVLDEYASDPGHFEGLRLFGNLSFNFLSEHDFGPAQCIQDYSDVFQVQNWRLCGPPPDPGLPDLVANDWVISQQRQYLEAIKALGVAGMRIDAVKHMPMSHINAVLTPEIRSGLHVFGEVITSGGAGDTSYDRFLAPYLAQSDHGAYDFPLFETIRRAFGFGGSMSELVDPAAYGQALPPDRAITFVITHDIPNNDGFRYQILDPVDESLAYAYILGRDGGVPLLYSDNNESGDGRWIDAWQRPDLVAMVGFHNAVHGQDMAVLSHDDCHLLFRRGSLGIVGINKCGHALSSWVNMNQSVLWWYADYTDVLDSNSVVNIQSSWHEFILPARQARLWLR

SEQ ID NO: 211 - DNA, 1491 bp, Unknown
  Obtained from an environmental sample.
gtgtttcgttctgacacagtttcgcgtacctgcatgtatggtgcgctgcgtaatgcctaccaacccgatcgggtgtttactggagtcacggtgcggacatgcaacttaaaaaagcatgctcatcgccaggcgctgttgttcatcgtgacgcggtgcctgtgcctgaaatccaggcagacccataaaaacaacaacaaaccgataacaaacgacccaagccttctaagaggagaaaacgggatggcttttaaactacgcaaaaaggcgctcgttggcctgttcacggccggcgcaatggtatatgccggtgcagcggcgagtggtgaaatcattctgcagggcttccactggcactccaagtggggcggcaacaatcagggttggtggcaggtgatggaaggtcaggccaacaccatcgccaacgccggctttacgcacgtgtggttcccgccggtccataactcggccgatgccgagggttacctaccccgcgagctgaacaacctcaactccagctatggctccgaagcacagctgcgcagcgccatccaggcactgaacaatcgcggcgtgcatgcgattgccgatgtggtcatgaaccaccgggtgggctgctctggctgggcggatttctgtaacccggactggccgacctggtacatcgtcgccaatgattcctggcccggtggcccgaaaagccagaactgggacacgggtgagacgtaccacgccgcccgtgacctcgatcacgccaatccgcaggtgcgcaacgatatctcgcactacctgaacagccgcctcaaggacgtcggcttctccggctggcgctgggactatgccaagggtttctggcccggctatgtcggcgagtacaactggaacaccaacccgaacttctgtgtgggtgaggtgtgggacgatctcgaccccaacaatcccaacccgcaccgccagcaactggtggactgggttgatgctaccggtggcagttgtcacgtcttcgacttcaccaccaaggggctgacgaactatgcgctgcagcatggccagtactggcgcctgcagggtgataatggtggcccggctggcggcatcggctggtggccgcaacgcatggtgaccttcgtcgacaaccatgacacgggcccgagcaatcactgtggtgacggccagaacctctggcccgtgccctgtgacaaggtcatggaggcgtatgcctacatcctgacccatccgggcgtgccgtcggtgtactggacgcacttcttcaactggaatcttggtagcgagatcagccagttgatgcagatccgcaagaaccagggcgtgcactccggttccgacgtctggatcgccgaggcccgtcacggcctgtacgccgcctatatcaacggtaatgtggcgatgaagatgggctgggataactggagcccgggctggggctggtcgctggcggcctccggtaacaactgggccgtctggacacgctga

SEQ ID NO: 212 - protein, 496 aa, Unknown
  Obtained from an environmental sample.
VFRSDTVSRTCMYGALRNAYQPDRVFTGVTVRTCNLKKHAHRQALLFIVTRCLCLKSRQTHKNNNKPITNDPSLLRGENGMAFKLRKKALVGLFTAGAMVYAGAAASGEIILQGFHWHSKWGGNNQGWWQVMEGQANTIANAGFTHVWFPPVHNSADAEGYLPRELNNLNSSYGSEAQLRSAIQALNNRGVHAIADVVMNHRVGCSGWADFCNPDWPTWYIVANDSWPGGPKSQNWDTGETYHAARDLDHANPQVRNDISHYLNSRLKDVGFSGWRWDYAKGFWPGYVGEYNWNTNPNFCVGEVWDDLDPNNPNPHRQQLVDWVDATGGSCHVFDFTTKGLTNYALQHGQYWRLQGDNGGPAGGIGWWPQRMVTFVDNHDTGPSNHCGDGQNLWPVPCDKVMEAYAYILTHPGVPSVYWTHFFNWNLGSEISQLMQIRKNQGVHSGSDVWIAEARHGLYAAYINGNVAMKMGWDNWSPGWGWSLAASGNNWAVWTR

SEQ ID NO: 213 - protein, 23 aa, Unknown
  Obtained from an environmental sample.
MFLLAFLLTASLFCPTGQPAKAA

SEQ ID NO: 214 - protein, 23 aa, Bacterial
VLTFHRIIRKGWMFLLAFLLTAS

SEQ ID NO: 215 - protein, 33 aa, Bacterial
MKSFAFMPILFYANDFISEREGGGKMGKNMRRR

SEQ ID NO: 216 - protein, 31 aa, Bacterial
MRKKMSHSRFTFLLILALFIFFSGCISEVKS

SEQ ID NO: 217 - protein, 30 aa, Bacterial
MYTLFIRSFYDTNNDGVGDYNGVAQKVDYL

SEQ ID NO: 218 - protein, 22 aa, Unknown
  Obtained from an environmental sample.
VLTFHRIIRKGWMFLLAFLLTA

SEQ ID NO: 219 - protein, 33 aa, Unknown
  Obtained from an environmental sample.
MSLFKKIFPWIVSLLLLFSFIAPFSIQTEKVRA

SEQ ID NO: 220 - protein, 25 aa, Unknown
  Obtained from an environmental sample.
MARKTLAIFFVLLVLLSLSAVPAKA

SEQ ID NO: 221 - protein, 35 aa, Unknown
  Obtained from an environmental sample.
MPAFKSKVMHMKLKYLALVLLAVASIGLLSTPVGA

SEQ ID NO: 222 - protein, 28 aa, Unknown
  Obtained from an environmental sample.
MKQQKRLYARLLTLLFALIFLLPHSAAA

SEQ ID NO: 223 - protein, 21 aa, Unknown
  Obtained from an environmental sample.
MRVFLVVPKLSRPFQAESQQQ

SEQ ID NO: 224 - protein, 30 aa, Bacterial
MQTFAFLFYSKKGWVCMNYLKKVWLYYAIV

SEQ ID NO: 225 - protein, 35 aa, Unknown
  Obtained from an environmental sample.
MPQAIRTFSRWTLFGLIGVFLLGLVFSVPPRAIQA

SEQ ID NO: 226 - protein, 28 aa, Unknown
  Obtained from an environmental sample.
VVHMKLKYLALVLLAVASIGLLSTPVGA

SEQ ID NO: 227 - protein, 30 aa, Unknown
  Obtained from an environmental sample.
VCMNYLKKVWLYYAIVATLIIYFLTPFSTA

SEQ ID NO: 228 - protein, 30 aa, Unknown
  Obtained from an environmental sample.
MPQLYPLPPRWRRAARQGLAALTLATTALG

SEQ ID NO: 229 - protein, 30 aa, Unknown
  Obtained from an environmental sample.
MNNVKKVWLYYSIIATLVISFFTPFSTAQA

SEQ ID NO: 230 - protein, 28 aa, Unknown
  Obtained from an environmental sample.
VGRAGLAHHSNTSAKGTYGSPLELRPDR

SEQ ID NO: 231 - protein, 23 aa, Unknown
  Obtained from an environmental sample.
MKTFNLKPTLLPLTLLLSSPVLA

SEQ ID NO: 232 - protein, 23 aa, Unknown
  Obtained from an environmental sample.
MKPINTLLISALAVCSFSSATYA

SEQ ID NO: 233 - protein, 30 aa, Unknown
  Obtained from an environmental sample.
MPKSTFTKSITKSLLATSVVVSLLPAYAQA

SEQ ID NO: 234 - protein, 27 aa, Unknown
  Obtained from an environmental sample.
MLKRITVVCLLFILLFPNIYGRNKAEA

SEQ ID NO: 235 - protein, 29 aa, Unknown
  Obtained from an environmental sample.
MSLNNFKVKLLSFAVSSAVLSLAPNLANA

SEQ ID NO: 236 - protein, 28 aa, Unknown
  Obtained from an environmental sample.
MILSNFKVKLLSFAVSSAVLTLAANVAN

SEQ ID NO: 237 - protein, 27 aa, Unknown
  Obtained from an environmental sample.
MLKRITVVCLLFILLFPNIYEGNKAEA

SEQ ID NO: 238 - protein, 26 aa, Unknown
  Obtained from an environmental sample.
MPSINASDCKKKGDRSMKRKKWTALA

SEQ ID NO: 239 - protein, 33 aa, Unknown
  Obtained from an environmental sample.
VSRMFAKRFKTSLLPLFAGFLLLFHLVLAGPTA

SEQ ID NO: 240 - protein, 25 aa, Unknown
  Obtained from an environmental sample.
MQTIAKKGDETMKGKKWTALALTLP

SEQ ID NO: 241 - protein, 25 aa, Unknown
  Obtained from an environmental sample.
MQKKGDETMKGKKWTALALTLPLAA

SEQ ID NO: 242 - protein, 36 aa, Bacterial
VDPKNCSQFMQTIAKKGDETMKGKKWTALALTLPLA

SEQ ID NO: 243 - protein, 36 aa, Unknown
  Obtained from an environmental sample.
MQTIAKKGDETMKGKKWTALALTLPLAASLSTGVHA

SEQ ID NO: 244 - protein, 23 aa, Unknown
  Obtained from an environmental sample.
MKTFKLKRTFLPLTLLLSAPAFA

SEQ ID NO: 245 - protein, 25 aa, Unknown
  Obtained from an environmental sample.
MQTIAKKGDETMKGKKWTALALTLP

SEQ ID NO: 246 - protein, 22 aa, Unknown
  Obtained from an environmental sample.
MKNIIRLCAASAILTVSHASYA

SEQ ID NO: 247 - protein, 23 aa, Unknown
  Obtained from an environmental sample.
MKTFKLKRTFLPLTLLLSAPAFA

SEQ ID NO: 248 - protein, 23 aa, Unknown
  Obtained from an environmental sample.
MKTFKLKRTFLPLTLLLSAPAFA

SEQ ID NO: 249 - protein, 25 aa, Unknown
  Obtained from an environmental sample.
MKLMKGKKWTALALTLPLAASLSTG

SEQ ID NO: 250 - protein, 36 aa, Unknown; identical to SEQ ID NO: 243
  Obtained from an environmental sample.

SEQ ID NO: 251 - protein, 25 aa, Unknown
  Obtained from an environmental sample.
MQTIAKKGDETMKGKKWTALALTLP

SEQ ID NO: 252 - protein, 25 aa, Unknown
  Obtained from an environmental sample.
MKFKKSLSAGLLLFGGLSGVTPSVA

SEQ ID NO: 253 - protein, 23 aa, Unknown
  Obtained from an environmental sample.
MKPSKFVFLSAAIACSLSSTANA

SEQ ID NO: 254 - protein, 23 aa, Unknown
  Obtained from an environmental sample.
VSLTKKAQYEPNTAPRLSTSLQS

SEQ ID NO: 255 - protein, 30 aa, Unknown
  Obtained from an environmental sample.
MTAKADDLRIYQIMVESFVDGDKQVGHGTG

SEQ ID NO: 256 - protein, 25 aa, Unknown
  Obtained from an environmental sample.
MKMKSRAWLLGSAVAMALASSAANA

SEQ ID NO: 257 - protein, 16 aa, Unknown
  Obtained from an environmental sample.
MYRVIPIILIMSMIVA

SEQ ID NO: 258 - DNA, 47 bp, Artificial Sequence
  Primer
gaacactagtaggaggtaacttatggcaaagtattccgagctcgaag

SEQ ID NO: 259 - DNA, 39 bp, Artificial Sequence
  Primer
gaacggtctcattccgccagccagcaaggggatgagcgg

SEQ ID NO: 260 - DNA, 33 bp, Artificial Sequence
  Primer
gaaccgtctcaaaacacggcccatgcctacggc

SEQ ID NO: 261 - DNA, 38 bp, Artificial Sequence
  Primer
gaacgtctcacctcgacttccaccccaacgaggtcaag

SEQ ID NO: 262 - DNA, 33 bp, Artificial Sequence
  Primer
gaacgtctcaggcgctttgactacgtgaagggc

SEQ ID NO: 263 - DNA, 32 bp, Artificial Sequence
  Primer
gaacggtctcaacaagatggatgaggcctttg

SEQ ID NO: 264 - DNA, 38 bp, Artificial Sequence
  Primer
gaaccgtctcacgatataatctggaacaagtaccttgc

SEQ ID NO: 265 - DNA, 35 bp, Artificial Sequence
  Primer
gaaccgtctcagaagcacgagcatagtttactacg

SEQ ID NO: 266 - DNA, 30 bp, Artificial Sequence
  Primer
gaaccgtctcaaaggtgggtttatgtgccg

SEQ ID NO: 267 - DNA, 36 bp, Artificial Sequence
  Primer
gaacgtctcaggaatccaaatggcggatattcccgc

SEQ ID NO: 268 - DNA, 33 bp, Artificial Sequence
  Primer
gaacggtctcagtttatcatattgatgagctcc

SEQ ID NO: 269 - DNA, 33 bp, Artificial Sequence
  Primer
gaaccgtctcagaggtagttggcagtatatttg

SEQ ID NO: 270 - DNA, 31 bp, Artificial Sequence
  Primer
gaacgtctcacgccaggcatcaacgccgatg

SEQ ID NO: 271 - DNA, 30 bp, Artificial Sequence
  Primer
gaacgtctcattgtagtagagcgggaagtc

SEQ ID NO: 272 - DNA, 32 bp, Artificial Sequence
  Primer
gaacggtctcaatcggtgtcgtggtttgctac

SEQ ID NO: 273 - DNA, 31 bp, Artificial Sequence
  Primer
gaaccgtctcacttccacctgcgaggtggtc

SEQ ID NO: 274 - DNA, 31 bp, Artificial Sequence
  Primer
gaaccgtctcaccttccaaccttgctcgagc

SEQ ID NO: 275 - DNA, 33 bp, Artificial Sequence
  Primer
tcgagactgactctcacccaacaccgcaatagc

SEQ ID NO: 276 - DNA, 50 bp, Artificial Sequence
  Primer
gaacactagtaggaggtaacttatggccaagtacctggagctcgaagagg

SEQ ID NO: 277 - DNA, 31 bp, Artificial Sequence
  Primer
gaacggtctcattcccccggcgagcaagggc

SEQ ID NO: 278 - DNA, 32 bp, Artificial Sequence
  Primer
gaaccgtctcaaaacaccgcccacgcctacgg

SEQ ID NO: 279 - DNA, 29 bp, Artificial Sequence
  Primer
gaacgtctcacctcgacttccaccccaac

SEQ ID NO: 280 - DNA, 31 bp, Artificial Sequence
  Primer
gaacgtctcaggcgcttcgactacgtcaagg

SEQ ID NO: 281 - DNA, 34 bp, Artificial Sequence
  Primer
gaacggtctcaacaagatggacgcggcctttgac

SEQ ID NO: 282 - DNA, 35 bp, Artificial Sequence
  Primer
gaaccgtctcacgatataatttggaacaagtaccc

SEQ ID NO: 283 - DNA, 31 bp, Artificial Sequence
  Primer
gaaccgtctcagaagcaccgacatagtctac

SEQ ID NO: 284 - DNA, 30 bp, Artificial Sequence
  Primer
gaaccgtctcaaaggtgggtctacgttccg

SEQ ID NO: 285 - DNA, 36 bp, Artificial Sequence
  Primer
gaacgtctcaggaatccatattgcggagattccggc

SEQ ID NO: 286 - DNA, 32 bp, Artificial Sequence
  Primer
gaacggtctcagtttatcatgttcacgagctc

SEQ ID NO: 287 - DNA, 33 bp, Artificial Sequence
  Primer
gaaccgtctcagaggtagttggccgtgtacttg

SEQ ID NO: 288 - DNA, 30 bp, Artificial Sequence
  Primer
gaacgtctcagccatgcgtcaacgccgatg

SEQ ID NO: 289 - DNA, 31 bp, Artificial Sequence
  Primer
gaacgtctcattgtagtagagcgggaagtcg

SEQ ID NO: 290 - DNA, 33 bp, Artificial Sequence
  Primer
gaacggtctcaatcggtgtcgtggtttgcaacg

SEQ ID NO: 291 - DNA, 34 bp, Artificial Sequence
  Primer
gaaccgtctcacttccaccggcgaggtggtcgtg

SEQ ID NO: 292 - DNA, 32 bp, Artificial Sequence
  Primer
gaaccgtctcaccttccggccttgctcgagcc

SEQ ID NO: 293 - DNA, 35 bp, Artificial Sequence
  Primer
tcgagactgactctcagcccaccccgcagtagctc

SEQ ID NO: 294 - DNA, 50 bp, Artificial Sequence
  Primer
gaacactagtaggaggtaacttatggccaagtactccgagctggaagagg

SEQ ID NO: 295 - DNA, 30 bp, Artificial Sequence
  Primer
gaacggtctcattcctcccgcgagcaaggg

SEQ ID NO: 296 - DNA, 31 bp, Artificial Sequence
  Primer
gaaccgtctcaaaacaccgcccacgcctatg

SEQ ID NO: 297 - DNA, 33 bp, Artificial Sequence
  Primer
gaacgtctcacctcgacttccacccgaacgagc

SEQ ID NO: 298 - DNA, 31 bp, Artificial Sequence; identical to SEQ ID NO: 280
  Primer

SEQ ID NO: 299 - DNA, 32 bp, Artificial Sequence
  Primer
gaacggtctcaacaagatggacgaggccttcg

SEQ ID NO: 300 - DNA, 30 bp, Artificial Sequence
  Primer
gaaccgtctcacgatataatctggaacaag

SEQ ID NO: 301 - DNA, 35 bp, Artificial Sequence
  Primer
gaaccgtctcagaagcactgacatcgtttactacg

SEQ ID NO: 302 - DNA, 30 bp, Artificial Sequence
  Primer
gaaccgtctcaaaggtgggtttacgttccg

SEQ ID NO: 303 - DNA, 30 bp, Artificial Sequence
  Primer
gaacgtctcaggaatccatatcgccgaaat

SEQ ID NO: 304 - DNA, 30 bp, Artificial Sequence
  Primer
gaacggtctcagtttatcatgtttatgagc

SEQ ID NO: 305 - DNA, 34 bp, Artificial Sequence
  Primer
gaaccgtctcagaggtagttggccgtgtatttac

SEQ ID NO: 306 - DNA, 30 bp, Artificial Sequence
  Primer
gaacgtctcacgccaggcatcgatgccgat

SEQ ID NO: 307 - DNA, 34 bp, Artificial Sequence
  Primer
gaacgtctcattgtagtagagggcgaagtcaaag

SEQ ID NO: 308 - DNA, 36 bp, Artificial Sequence
  Primer
gaacggtctcaatcggtatcgtggttggctacaaac

SEQ ID NO: 309 - DNA, 34 bp, Artificial Sequence
  Primer
gaaccgtctcacttcctccggcgaggttgtcatg

SEQ ID NO: 310 - DNA, 32 bp, Artificial Sequence
  Primer
gaaccgtctcaccttccggctttgcttgaggc

SEQ ID NO: 311 - DNA, 36 bp, Artificial Sequence
  Primer
tcgagactgactctcacccaacaccgcagtagctcc

SEQ ID NO: 312 - DNA, 38 bp, Artificial Sequence
  Primer
cacacagcagcaaccaacctcgagactgactctcascc

SEQ ID NO: 313 - protein, 461 aa, Pyrococcus sp.
MKKFVALLITMFFVVSMAAVAQPASAAKYSELEEGGVIMQAFYWDVPAGGIWWDTIRSKIPEWYEAGISAIWIPPASKGMGGAYSMGYDPYDFFDLGEYNQKGTVETRFGSKQELINMINTAHAYGIKVIADIVINHRAGGDLEWNPFVGDYTWTDFSKVASGKYTANYLDFHPNEVKCCDEGTFGGFPDIAHEKEWDQHWLWASDESYAAYLRSIGVDAWRFDYVKGYGAWVVKDWLNWWGGWAVGEYWDTNVDALLNWAYSSGAKVFDFPLYYKMDEAFDNTNIPALVDALQNGGTVVSRDPFKAVTFVANHDTDIIWNKYPAYAFILTYEGQPVIFYRDYEEWLNKDKLNNLIWIHDHLAGGSTSIVYYDSDELIFVRNGDSKRPGLITYINLGSSKVGRWVYVPKFAGACIHEYTGNLGGWVDKYVESSGWVYLEAPAYDPASGQYGYTVWSYCGVG

SEQ ID NO: 314 - protein, 460 aa, Pyrococcus furiosus
VNIKKLTPLLTLLLFFIVLASPVSAAKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 315 - protein, 484 aa, Thermococcus sp.
SESQCTATCTWRVVYMSAKKLLALLFVLAVLVGVAVIPARVGIAPVSAGATSRPSLEEGGVIMQAFYWDVPAGGIWWDTIRSKIPDWASAGISAIWIPPASKGMSGAYSMGYDPYDFFDLGEYYQKGTVETRFGSKQELINMINTAHSYGIKVIADIVINHRAGGDLEWNPFTNSYTWTDFSKVASGKYTANYLDFHPNEVKCCDEGTFGGFPDIAHEKSWDQYWLWASQKSYAAYLRSIGIDAWRFDYVKGYGAWVVKDWLKWWALAVGEYWDTNVDALLNWAYSSGAKVFDFPLYYKMDEAFDNKNIPALVSALQNGQTVVSRDPFKAVTFVANHDTDIIWNKYPAYAFILTYEGQPVIFYRDYEEWLNKDRLKNLIWIHNNLAGGSTSIVYYDNDELIFVRNGYGNKPGLITYINLGSSKVGRWVYVPKFAGSCIHEYTGNLGGWVDKYVGSNGWVYLEAPAHDPAKGQYGYSVWSYCGVG

SEQ ID NO: 316 - protein, 457 aa, Thermococcus hydrothermalis
MARKVLVALLVFLVVLSVSAVPAKAETLENGGVIMQAFYWDVPGGGIWWDTIAQKIPDWASAGISAIWIPPASKGMSGGYSMGYDPYDFFDLGEYYQKGSVETRFGSKEELVNMINTAHAHNMKVIADIVINHRAGGDLEWNPFTNSYTWTDFSKVASGKYTANYLDFHPNELHAGDSGTFGGYPDICHDKSWDQHWLWASNESYAAYLRSIGIDAWRFDYVKGYAPWVVKNWLNRWGGWAVGEYWDTNVDALLSWAYDSGAKVFDFPLYYKMDEAFDNNNIPALVDALKNGGTVVSRDPFKAVTFVANHDTNIIWNKYPAYAFILTYEGQPAIFYRDYEEWLNKDRLRNLIWIHDHLAGGSTDIIYYDSDELIFVRNGYGDKPGLITYINLGSSKAGRWVYVPKFAGSCIHEYTGNLGGWIDKWVDSSGRVYLEAPAHDPANGQYGYSVWSYCGVG

SEQ ID NO: 317 - protein, 340 aa, Artificial Sequence
  Consensus sequence
SALEGGVIMQAFYWDVPGGIWWDIKIPWAGISAIWPPSKGMGYSMGYDPYDFDLGEYQKGETRFGSKELITAHKVIADVINHRAGGDLEWNPFYTWTDFSKVASGKYTANYLDFHPNEDGTFGGPDIHKWDQWLWSSYAAYLRSIGDWRFDYVKGYWVVWLWAVGEYWDTNVDALLWAYSGAKVFDFPLYYKMDEAFDNNIPALVALNGTVVSRDPFKAVTFVANHDTIIWNKYAYAFILTYEGQPIFYRDEEWLNKDLNLIWIHLAGGSTIYYDDEIFVRNGPGLITYINLGRWVYVPKFAGCIHEYTGNLGGWDKVSGVYEAPDPAGYGYVWSYCGVG

SEQ ID NO: 318 - protein, 463 aa, Artificial Sequence
  Clone
MRRSARVLVLIIAFFLLAGIYYPSTSAAKYSELEQGGVIMQAFYWDVPEGGIWWDTIRQKIPEWYDAGISAIWIPPASKGMGGAYSMGYDPYDYFDLGEFYQKGTVETRFGSKEELVNMISTAHQYGIKVIADIVINHRAGGDLEWNPYVGDYTWTDFSKVASGKYKAHYMDFHPNNYSTSDEGTFGGFPDIDHLVPFNQYWLWASNESYAAYLRSIGIDAWRFDYVKGYGAWVVKDWLSQWGGWAVGEYWDTNVDALLNWAYSSGAKVFDFPLYYKMDEAFDNKNIPALVYAIQNGETVVSRDPFKAVTFVANHDTNIIWNKYPAYAFILTYEGQPVIFYRDYEEWLNKDKLNNLIWIHEHLAGGSTKILYYDDDELIFMREGYGDRPGLITYINLGSDWAERWVNVGSKFAGYTIHEYTGNLGGWVDRYVQYDGWVKLTAPPHDPANGYYGYSVWSYAGVG

SEQ ID NO: 319 - protein, 306 aa, Artificial Sequence
  Consensus sequence
GGIMQAFYWDVPGGIWWDIKIPWAGISAIWPPSKGMGYSMGYDPYDFDLGEQKGETRFGSKELITAHKVIADVINHRAGGLEWNPYTWTDFSKVASGKYAYDFHPNDGTFGGPDIHQWLWSSYAAYLRSIGDWFDYVKGYWVVWLWAVGEYWDTNVDALWAYSAKVFDFLYYKMDAFDNNIPALVAGTVVSRDPFKAVTFVANHDTIIWNKYAYAFILTYEGQPIFYRDEEWLNKDLNLIWIHLAGGSTIYYDDEIFRGPGLITYINLRWVVKFAGIHEYTGLGGWDVGVAPDPAGYGYVWSYGVG

SEQ ID NO: 320 - DNA, 1392 bp, Artificial Sequence
  Clone
atgaggagatccgcaagggttttggttctgattatagcgtttttcctcctggcggggatttactacccctccacgagtgccgcgaagtactccgagctggagcagggcggagtcataatgcaggccttctactgggacgttccggagggaggaatctggtgggacacaatacggcagaagatccctgaatggtacgatgcaggcatatccgccatctggatacccccggcgagcaagggcatgggcggggcctactcgatgggctacgacccctacgattacttcgatctgggcgagttttaccagaagggaaccgttgagacccgcttcggctccaaggaagagctcgtcaacatgatctccacggcccaccagtacggcatcaaggttatagcggacatagtgataaaccaccgcgcaggtggagacctcgaatggaacccatacgtcggcgactatacctggacggacttttctaaggtcgcctccgggaaatacaaggcccactacatggacttccatccaaacaactacagcacctcagacgagggaaccttcggtggcttcccagacattgatcacctcgtgcccttcaaccagtactggctgtgggcgagcaacgagagctacgccgcctacctcaggagcatagggatcgatgcgtggcgctttgactacgttaagggctacggcgcgtgggtcgtcaaggactggctgagtcagtggggcggctgggccgtcggcgagtactgggacaccaacgtcgatgcgctcctcaactgggcctacagcagcggcgccaaggtcttcgacttcccgctctactacaagatggacgaggcctttgacaacaagaacattcccgccctcgtttacgccatccagaacggtgaaaccgtcgtcagcagggatcccttcaaggccgttaccttcgtggctaaccacgatacgaacataatctggaacaagtaccctgcctatgccttcatcctgacctacgaaggtcagcccgtcatcttctaccgcgactacgaggagtggctcaacaaggacaaactcaacaacctcatatggattcacgagcacctggcagggggaagcaccaagatcctctactacgacgacgatgagctcatcttcatgagggaaggctacggcgacaggcccgggcttataacctacatcaacctcggtagcgactgggcggagagatgggtgaacgttggctcaaagttcgcgggctatacaatccacgaatacaccggaaacctcggcggctgggtcgacaggtacgtccagtacgacggctgggtcaagcttaccgctccgccacacgatccggcaaacggctattacggctactcggtctggagctacgccggagttggatga

SEQ ID NO: 321 - DNA, 846 bp, Artificial Sequence
  Consensus sequence
ggcggtataatgcaggcttctatgggagtccggaggaattggtgggacacataagatccgatgggcggattcgcattggatccccgcagaagggatggcgggtatcatgggctacgaccctacgatttgactgggagtacagaagggatgaacgttggtcaaagacttaaatgatcacgccaacataaggtatgcgaatgtataaccaccgcgcgggggctgatggaacctcctaacctggacgatttcaagtgctcggaataagccactactgacttccaccaacagaggacttggggtccgaatcacctaccagactggcttgggcagcgaagctacgcgctactggagcatggtgagctgggttgactacgtaagggctagctgggtgtaactggctgtggggggctgggcgtgggagtactgggacacaacgtgagctctactgggctacagcggcaagtcttgacttccctctactacaagatggaggccttgaaaaaacatccgctgtgctaggacgtgtccggaccttaagcgtacttgtgcaaccacgaacaataattggaacaagtacgctagcttcatcctacctagaggcagccattttaccgcgactacgaggagtggctcaacaaggaataaacctcattggatcagaacctgcggggagacatttactacgacgagatattttagaggctaggcaccggctataactaatcaacctgcggagtgggtagtcaagttcgcggatcacgataacggactcggggtggtgacagtgttcgggggtatgccccacgaccgcaaggataggctactcgttggagctacgggtggtga

SEQ ID NO: 322 - DNA, 1392 bp, Unknown; identical to SEQ ID NO: 320
  Obtained from an environmental sample

SEQ ID NO: 323 - protein, 463 aa, Unknown; identical to SEQ ID NO: 318
  Obtained from an environmental sample
  SIGNAL (1)...(27)

SEQ ID NO: 324 - DNA, 1296 bp, Unknown
  Obtained from an environmental sample
atgaccagcagcctgaaaaccaccagcatacccttcatctacaacattttcccgtcgctcctcggcgaggtcgacaagtggattccgcatgtcgagcgtgcggtggaaatgggcttcaactggatattcatcaatcccattcatttgaccggcgccagcggatcgctgtacgccatccgcgactatttccagttcaacccggcgtttttcccctacgactcgttcgacgcgcagaaaaaccgtctgtcggcgtttgtctcgcagtgccgcgagatgggggcggaggtgatgatcgatctggtcatcaaccataccgcctacgacaaccccctgacccgcgatcaccgcaactggtacaagctgaacgccgacggttcgataaaaaatcccggcgccagggacgacagcgcgcccggcgggtatgtggtttggggcgacttgaacgagatagacaacgagcattccccggaccggaacaatttgtgggaatattggtggtcggtggtggacatgtatctgtcctgcggcgtgcgcggattccgttgcgacgcggcttatcagattccgaacgacttgtggcggctgcttatagaacgcgccaagaacaagcattccgaatgccgtttcttcgcggagtctctcggctgtcccatggaacagaccgtcaacctggcgaaagcgggccacgacttcgttttcaactccggcaagtggtgggattatcgccaggactggtttatcgatcagatgcgcatggtttccggccaggcgtcttcgatttgtttccccgagtcccacgacaccgaacgtttggcggcggagtggggtcgggatttggagcggatcaagcagcattatcttttcagcgcgttgatatcgtccggcgtcctcatccttctcggcttcgagtacggcttcatgaaaaagccacatgtcgtgcactcgcatccgcacgattacgagggcgcgaattacgatttgaccgactacatccgggaaatcaattccctcaagcgcgcccaccgggtattcgccgaggacaataaattcgaacggcttgattccggagacgacggcgtgctggcgctgcggaagacgacgctggacggcaaggagagcggcctgcttctcttcaaccgtaccggcgatcgcaaaacccttcacctgggcgacttgatcaaccgcatgcatgccaacccgtaccgtttcaccgcggccgccaacgtcaagctccccgccaaggccgagcgtatcgagatcaaccggtatggcgcggtggcgttccggttgtattga

SEQ ID NO: 325 - protein, 431 aa, Unknown
  Obtained from an environmental sample
MTSSLKTTSIPFIYNIFPSLLGEVDKWIPHVERAVEMGFNWIFINPIHLTGASGSLYAIRDYFQFNPAFFPYDSFDAQKNRLSAFVSQCREMGAEVMIDLVINHTAYDNPLTRDHRNWYKLNADGSIKNPGARDDSAPGGYVVWGDLNEIDNEHSPDRNNLWEYWWSVVDMYLSCGVRGFRCDAAYQIPNDLWRLLIERAKNKHSECRFFAESLGCPMEQTVNLAKAGHDFVFNSGKWWDYRQDWFIDQMRMVSGQASSICFPESHDTERLAAEWGRDLERIKQHYLFSALISSGVLILLGFEYGFMKKPHVVHSHPHDYEGANYDLTDYIREINSLKRAHRVFAEDNKFERLDSGDDGVLALRKTTLDGKESGLLLFNRTGDRKTLHLGDLINRMHANPYRFTAAANVKLPAKAERIEINRYGAVAFRLY

SEQ ID NO: 326 - DNA, 1359 bp, Unknown
  Obtained from an environmental sample
gtggaaggactctggctcacccctttcttccagtctccgtcttatcacaaatatgacgtgacgaattatatggagatcgatccggaatacgggaccaaagatgatttcaggagattgctggacgaagcccacaagcgtggcctcaaggtcatcatcgattttgtgatcaaccacaccagcagccagcacccctggttcctggaggccaggaaaggcaaagacaatccttaccgcaattattacctgtggatggagcccgccgaaatcgaaaggatgggcatcgcggtgcgggaaaaaaccgccgactcctgggaaacgcagccctggcactgggccagccgcggcgacaaggaaaagtattacgggatgttctggaacgggatgcctgatcttaatatggacaaccgtgaggtgagagaacagatttatgccatcggcaaatactggctcgaattcggggctgacggcttcaggatggatgctgccaaacacatttatcccagttgggaagccgaaaagtcgcacgacttctgggtggagttcagagagcggatggaggctgtcaagcctggcttttacctggtgggggaggtgtggacatcggcagaaaaggtagccccgtttttccggggactgaaagccaacttccattttgacctgagcctggccctgcagaaaatagcggcgggacaggacagcggatcaggactggtgaacatgctgctgggcaattacgagatattcggaagagagaacccggcgtttattgacgccacgatgctgaccaaccacgaccaggagaggctgggaagtgcggtaggcaacgataaaaataagatgaagctggctgctaacctgctgctgaccctgcccggtaatccctatctttattacggggaagaactggggatgctcggcaaaaagcctgatgaaaacatcagggaggcgtttctgtgggatacgcgggcgaatgaccgcgaccggaccaactggaagaaacccaattttaataccgattcccgggtgacacccctgaagttgcaacagcaggacccggactcagtttatcatcattacaagaaactgatccgattaagaaaggatcacccggcattgtggcaggtatccccgccgaatcttcaggcggcacaaacggctcaggaaggtttcgtgacgttcattcgtccgcacgaaagcgggagtttgctggtcatacagaacctgcagaacaacaccgccctggtggaagtaaaagaggacatcactgagacggtattcagcactgcaggttttcggaataccgaagggaaggtcatggaaataccggggtttgggatggtggtttttaggttggggtag

SEQ ID NO: 327 - protein, 452 aa, Unknown
  Obtained from an environmental sample
MEGLWLTPFFQSPSYHKYDVTNYMEIDPEYGTKDDFRRLLDEAHKRGLKVIIDFVINHTSSQHPWFLEARKGKDNPYRNYYLWMEPAEIERMGIAVREKTADSWETQPWHWASRGDKEKYYGMFWNGMPDLNMDNREVREQIYAIGKYWLEFGADGFRMDAAKHIYPSWEAEKSHDFWVEFRERMEAVKPGFYLVGEVWTSAEKVAPFFRGLKANFHFDLSLALQKIAAGQDSGSGLVNMLLGNYEIFGRENPAFIDATMLTNHDQERLGSAVGNDKNKMKLAANLLLTLPGNPYLYYGEELGMLGKKPDENIREAFLWDTRANDRDRTNWKKPNFNTDSRVTPLKLQQQDPDSVYHHYKKLIRLRKDHPALWQVSPPNLQAAQTAQEGFVTFIRPHESGSLLVIQNLQNNTALVEVKEDITETVFSTAGFRNTEGKVMEIPGFGMVVFRLG

SEQ ID NO: 328 - DNA, 1677 bp, Unknown
  Obtained from an environmental sample
gtgcagatctcgccgccgaacgagcacgcctggatcacgagcggcgacggcgcgccgtacccgtggtggatgcgctaccagccggtcagctacagcctcgatcggagccgcagcgggacccgcgccgagctcgccagcatggtgagccggtgcgccgccgcgggcgtgcagatctacgccgacgcggtgatcaaccacatgacgggcggctcgggcacgacgtcgagcgccggcaaccggccgtggggcgtgaagagctacccgaacgtcccgtacggcgtgaacgacttccacgcgacgtgcgcgatcaccagctacggtgacgcaaatcaggtccagaactgcgagctcgccgggctccaggacctgaacaccggctcctcctacgtgcgcggcaagatcgtcgactacctggtcgatctctacaacctcggcgtccgcggcttccggatcgacgcggccaagcacatcagcccgaccgacgtgacggcgatcgtcgccgccgtcgaggcccgcgtcccgacgaagccgttctggttcctcgaggtgatcggcgccttcggcgaggccgtgcagccgaatcagtacttcaatgtcgccgaggggcgcgcgacggtgacggagttcgcgtacggccgcgagctgtacggcaagttcgcgggcggcggccggctggccgaactccgcacgttcggcgagacgtggaacctcttgccgggcgaccgcgcgatcgcgttcaccgacaaccacgacaagcagcgcggccacggcggcggcggcacgtacctcacgtatcacaacggggcgacctacgacctcggcaacgtcttcatgctggcgtggccgtacggctacccggcgctcatgtcgagctacgcgttcaacaagaccaccgattacgacacgagctacgggccgccgcacgactcggcgaccggcgcgacgcgcggcccgtgggacggcggcgtctccgcccccgcgtgcttcaaccagacccgcggcggctgggtctgcgagcaccgcttccgcccgatcggcaacatggtggcgttccgcaaggcgacgatgggcaactggaccgtcaccgactggtgggacaacggcaataaccagatcgcgtttggccgcggcggctcgggattcgtggtcatcaacaaggaggcggccgcgctgactcgcacgttcaagacgagcctcgccgccggcaagtactgcgacgtcatctcgggcgactggaacgcgggcgcgggcacctgcgccggcaacgtcgtgaccgtcgacgcgaccggcaacgcgagcatcaccgtcggggcgttcggcgccgcggcgatccacgccggcgccaagctgggcggcggcggcggcggcggcaccgcctcggtgacgttcaacgaggcggcggacaccgtctttggccagaacatctacgtggtcggcagcgtgccggcgctggcgagctggaaccccgcgagcgcggtgccgatgacctggatctcgggctcggggacgcgcggcaactggcgcgcgacggtgacgctgcccgcgtcgactgcgatcgagtacaagtacatcaagaaggacggcgcgggcaccgtcatctgggagtccggcgccaaccgcacgctgaccaccggcggcgccggcagcacgctgacgacgaacgacagctggaagtag

SEQ ID NO: 329 - protein, 558 aa, Unknown
  Obtained from an environmental sample
MQISPPNEHAWITSGDGAPYPWWMRYQPVSYSLDRSRSGTRAELASMVSRCAAAGVQIYADAVINHMTGGSGTTSSAGNRPWGVKSYPNVPYGVNDFHATCAITSYGDANQVQNCELAGLQDLNTGSSYVRGKIVDYLVDLYNLGVRGFRIDAAKHISPTDVTAIVAAVEARVPTKPFWFLEVIGAFGEAVQPNQYFNVAEGRATVTEFAYGRELYGKFAGGGRLAELRTFGETWNLLPGDRAIAFTDNHDKQRGHGGGGTYLTYHNGATYDLGNVFMLAWPYGYPALMSSYAFNKTTDYDTSYGPPHDSATGATRGPWDGGVSAPACFNQTRGGWVCEHRFRPIGNMVAFRKATMGNWTVTDWWDNGNNQIAFGRGGSGFVVINKEAAALTRTFKTSLAAGKYCDVISGDWNAGAGTCAGNVVTVDATGNASITVGAFGAAAIHAGAKLGGGGGGGTASVTFNEAADTVFGQNIYVVGSVPALASWNPASAVPMTWISGSGTRGNWRATVTLPASTAIEYKYIKKDGAGTVIWESGANRTLTTGGAGSTLTTNDSWK

SEQ ID NO: 330 - DNA, 3129 bp, Unknown
  Obtained from an environmental sample
atgataaacgaacttgaattaactcccaccttggaaacaaccctaaccgaaatcgtggcccggcggcgcgttccccgggccacctatcgtctccagtttaatgccaactttaccctggcccaggccgaggccctggtcccttacttcgacgagctgggtattagcgattgttacgcctcgcccctgttggcggcctgtcctggcagcgagcacggctatgatgtctgtgatcccagccggctcaatccggccctgggcgatgagcaagcgtttgagtcttttacctcggccctccacgcccacaatatgggcctcattttagatacggtgcccaaccatatgggcattagcctgcctgagaatggctggtggttggatgtcctggaaaatggcccggcgtcaccctacgccgcctattttgatattgactggcatccaatcaagtccgaactgaacaataaagtcctgctgcctattttggagaatcagtacgggcgggtgttggaaagcggcaagttggaactggtctatgaaaatggggccttttttatctactattatgacaccaagctgccggtttccccccgtagctaccgcctcattctaaccgagtgtctggcgaggctggatgaggaactggctgaggcggatgaggatctgcaagagtttcgcagtatcctcacggccttggagcacttgccgccccgcaccgccgccgagacagaggccctggtcgaacggagccgggaaaaagaggtggtcaaacgccggctggccaatctgacccagagcaacgccaccgtgcaggcggctatcgaggcggccgtgaccaccctgaacggtcgccctggggagccggaaagttttgacgctctacacgccctgctcgaagaccaatcgtaccggctggccttctggcgggtcgcggccgacgaaattaattaccgccgctttttcgatatcaacagcctggccgccatccgggtcgaattaccccaggtgtttgccgatacccacgccctcattttccgctggctggccgagggcaaagttaccgggctgcgtattgatcaccccgatggcttgtggagcccgggtggctacttcaaacagttgcacgaaaattacctcctcgatcagttggccccggcggcaacgggcgtcgagcaagaggaattgcatcaggccattgtggcctggctggaaaccgttgaggcgagctggacggaggcggatcaggcagaaccggccgaggctgctcttccctggccgctgtacatagtggccgaaaaaattctgtctgagacggagccgctgcccccggattgggccgttgacggcaccaccggctatgattttctgaaccaggtcaatggggtattcatcaatcgccagagcgagcgggcttttgatcgtatttatcgccgttttaccggcatttcggccaattttgccgagctggccattcaaaccaaagatatgattatgcggctcgccctggccagtgaggttaacctgctggcccatcagttggagcaaatcaacgaaaagaaccgccgctaccgggatttcaccctgagtggggtgacggcagccctacgggaggtcctggcctgtttgccgatctaccggacctacattaccccgccccatccggtcacggcccgcgacgagagctacatcgaagcggcggtggccgaggcccggcggcgcaacccgcgcttgagcacctcgctgctgaactttctgcgcgatacgctcctgctgcgcaatctcgacgattttgccccggtcgaccggccccagatcgttaatttcgtgatgaagtttcagcaagtttccgggcctctcaccgccaaggggctggaggacacggctttttacgtctataaccggttcgtctccctcaacgaggtcggcgggcaccccggccagtttggcttgagggtggaagactttcaccagcagaatcaagagcgcctggcccattggccgcacagtatgttaaccacctccactcacgataccaagcggagtgaggatgtgcgggcgcgcctcaatgtgttttcggaaatgccggaggagtggcgcatggccctctcccgctggcgccggctcaacgaggcccataaaatcaccatcgacggcgaaccggcccctgaccgcaacgacgagtatctgttttaccagaccgtggtcggggcctggccctttgctgtcaatgagggcatggactcggctgcccaaagcggcattgcccggccggttgtctctcggttgatgcagccgggccggggtgagttggccggtttccgagaccggattctggcttatatgcaaaaggcgaccaacgaggccaaggttcataccagttggatcaatcctaacgaagcctacgacaaggccctggaaaaatttgtgtgtgacagccttgacaaccaacgggccaatcgctttctgggcgaactgctggccttcaccgaacgggtggcctatttcggccagtttaacagcctgagccaactgctgctcaagctgaccgcccccggcgtgcccgatctttatcagggtaccgagctgtgggatttcagcctggttgatcccgataaccgccggccggtcgattacgaccagcggcagcgcttgctggccgagttaaagcaaagtatcgccggtggccagccggaacaaggccaaatcctggcccaaaacttgctggaaacgagccacgatggccggatcaaattttatatcacagcccgtaccctgaattttcgccgggagcagcccgagctatttgaccagggggactaccagccgctggcggccagcggtgaccaaagtgaccatatcatcgcctttagccggagctggggcgatgaaaattttatcgtcgtcgtcccccggttggtctttagcctgatggcaggcgttgaacgcccgcccctggccaatgtctggggtgatacctggctacacctgcccgacccggcagccaaccgatcctaccggcatctgttcaccggccaaacgctttcaccgcaatcaatcagtgatggcccaggtctaccgctcgccgatgtttttgcgaattttccggtagccttgcttgttaataaaagttcgtag

SEQ ID NO: 331 - protein, 1042 aa, Unknown
  Obtained from an environmental sample
MINELELTPTLETTLTEIVARRRVPRATYRLQFNANFTLAQAEALVPYFDELGISDCYASPLLAACPGSEHGYDVCDPSRLNPALGDEQAFESFTSALHAHNMGLILDTVPNHMGISLPENGWWLDVLENGPASPYAAYFDIDWHPIKSELNNKVLLPILENQYGRVLESGKLELVYENGAFFIYYYDTKLPVSPRSYRLILTECLARLDEELAEADEDLQEFRSILTALEHLPPRTAAETEALVERSREKEVVKRRLANLTQSNATVQAAIEAAVTTLNGRPGEPESFDALHALLEDQSYRLAFWRVAADEINYRRFFDINSLAAIRVELPQVFADTHALIFRWLAEGKVTGLRIDHPDGLWSPGGYFKQLHENYLLDQLAPAATGVEQEELHQAIVAWLETVEASWTEADQAEPAEAALPWPLYIVAEKILSETEPLPPDWAVDGTTGYDFLNQVNGVFINRQSERAFDRIYRRFTGISANFAELAIQTKDMIMRLALASEVNLLAHQLEQINEKNRRYRDFTLSGVTAALREVLACLPIYRTYITPPHPVTARDESYIEAAVAEARRRNPRLSTSLLNFLRDTLLLRNLDDFAPVDRPQIVNFVMKFQQVSGPLTAKGLEDTAFYVYNRFVSLNEVGGHPGQFGLRVEDFHQQNQERLAHWPHSMLTTSTHDTKRSEDVRARLNVFSEMPEEWRMALSRWRRLNEAHKITIDGEPAPDRNDEYLFYQTVVGAWPFAVNEGMDSAAQSGIARPVVSRLMQPGRGELAGFRDRILAYMQKATNEAKVHTSWINPNEAYDKALEKFVCDSLDNQRANRFLGELLAFTERVAYFGQFNSLSQLLLKLTAPGVPDLYQGTELWDFSLVDPDNRRPVDYDQRQRLLAELKQSIAGGQPEQGQILAQNLLETSHDGRIKFYITARTLNFRREQPELFDQGDYQPLAASGDQSDHIIAFSRSWGDENFIVVVPRLVFSLMAGVERPPLANVWGDTWLHLPDPAANRSYRHLFTGQTLSPQSISDGPGLPLADVFANFPVALLVNKSS

SEQ ID NO: 332 - DNA, 1707 bp, Unknown
  Obtained from an environmental sample
atgtcgaacaagaaggcgttgggggcggtactcgcgaccactctgctgccggggttggcgctggcgggcagcagtgacgtgttgatgcagggcttccactggaagtccaccaaccaggtgggctggtacaacaccgtcaagagcaaggcgggcgagctcggagcggctggcatcaaccatgtctggctcccgccgccctccaagtcgggagcgccccagggctaccttcccacggagctcaacgtgctggactcggcgtacggcacggagctgcaactgaaggacgccatctccgcgctgaacgcggcgggggtgagcgcggtggcggacatcgtggtgaaccatcgcaacggctcgacggcgtggcacgacttccgcaacccggactggggcacggactccatcgtggccaatgacgagtgctggagcacggcgggctccacctgcacgagcagcatggtgcgcggggccaacgacagcggcgagccgtacgccgccgcgcgcgacgtggaccacggcaagcagtacgtgcgcgacagcctcgtgggctggatggggacgcggctggcgaacgtgggcttcgacggctggcgcttcgacttcgtgaagggcttcagcggcgcgtacgtgggcgagtacgtggcccgcaccgcgccgacgttctgcgtgggcgagttctggccgacgaactacttcgacctgaatgacccggccaactggcgcaaccagattatcggctgggtggatgccacgggcggccggtgcagcgccttcgacttcgtcaccaagggcctgctcaaccaggtgctggccaacggcgactacgggcggctgaagacggcggacggcaagccgacgggaacgattggcgtgcggccggcgcgctcggtcaccttcgtggacaaccacgacacgggccccagcgaggcgtgcggggatggtcagaaccactggccggtgccgtgcgacaaggtgatggcgggctacgcctacatcctcacgcacccgggtgtgccgacggtgtactggacgcactattacaacttcggcctgaaggcgcagctcgacaagctcatcagcatccgcaagacgaacggcctgcagtcggagtcggtggtcaacatcgtccgggccgagcagaacctgtacgcggccatcatcgacgccaaggtggcgatgaagatcggctcggggagctggagcccgggcacggactggacgctggccgcttccggtacggactacgcggtgtggaccaagggcaccacgcctccgccccccaccggctgcacccagccgtcgatgaacctgcgcggcacgttcaacaacttcggcagcgccgccatgacgtgcaagggcggcaacacctgggagatcaccaacgtcaccttcggtggcgccgcgacggaccgcttcaagttcgacgtgtttggtgactggacccggaactatggcgacaccaacaacgatgggaccgccgagctgtcgggtggggacatctccctcaccaccgcgggcacctacaccctccagttcaacgacagcacgctgcgctacacggtcacccgcaccagcaccccaccgccgcccacgggcaccagcgttcgcttcgtctgccagaacggcaccaccttcgtgggacagaacgtgcacgtcgtgggcagcatccccgagctggggagctgggatgcgacgaagtccatcaag

SEQ ID NO: 333 - protein, 569 aa, Unknown
  Obtained from an environmental sample
  SIGNAL (1)...(22)
MSNKKALGAVLATTLLPGLALAGSSDVLMQGFHWKSTNQVGWYNTVKSKAGELGAAGINHVWLPPPSKSGAPQGYLPTELNVLDSAYGTELQLKDAISALNAAGVSAVADIVVNHRNGSTAWHDFRNPDWGTDSIVANDECWSTAGSTCTSSMVRGANDSGEPYAAARDVDHGKQYVRDSLVGWMGTRLANVGFDGWRFDFVKGFSGAYVGEYVARTAPTFCVGEFWPTNYFDLNDPANWRNQIIGWVDATGGRCSAFDFVTKGLLNQVLANGDYGRLKTADGKPTGTIGVRPARSVTFVDNHDTGPSEACGDGQNHWPVPCDKVMAGYAYILTHPGVPTVYWTHYYNFGLKAQLDKLISIRKTNGLQSESVVNIVRAEQNLYAAIIDAKVAMKIGSGSWSPGTDWTLAASGTDYAVWTKGTTPPPPTGCTQPSMNLRGTFNNFGSAAMTCKGGNTWEITNVTFGGAATDRFKFDVFGDWTRNYGDTNNDGTAELSGGDISLTTAGTYTLQFNDSTLRYTVTRTSTPPPPTGTSVRFVCQNGTTFVGQNVHVVGSIPELGSWDATKSIK

SEQ ID NO: 334 - DNA, 2061 bp, Unknown
  Obtained from an environmental sample
atggtagcaggctttgggctctacggagctgccttgctcaccccaatggcggcacaggccgaaacgggcagagaagtcatgctgcagggctttaactggaattccacctcgcaagcgggtgggcactataatgagctggcaaatcgtgctggtgaaatcgctggggctggtatcgacattgtttggttcccacctccatccagagccgcagaccgggttggatacctgcccaacgagtggtataatatgaactccaattatggaaatcggacgactctacaggcggctatcgggaatcttcgcaacaacggtgtcaaaaccgtcgcggatattgtcgttaaccaccgtgtgggcacaacgaattgggcggacttcacgaatccttctttcggtgataacaaccgtgccatcacacgcgatgatgaatggcatcagtcgtcgggtaactgggataccggtgaggcgtatagtgccgcccgtgacttggaccacacctacggccccgtgcaaaatgagattaaaaactggctgaattggttgaagagtgacatcggctttgatggttggcgctatgatatggtcaagggattcagcgggtactatgtgggcgagtacaacacagcaactagcccctacatttccgttggtgagttcttcgactatgatcgccagaaggtggtcggctggatcaacgccaccaatgctcgctctcgcgccttcgattttccaacacgcaacctcctctatgtggctgtcacccaaaacaactacggagttcttcgtgatggtgaaggtaaggccaatggactcatcggttggtggccacaacgggctatcacattcattgagaaccatgatacggaagaagcccgcaacggtgagtacacccccgccttcccccaatgggctaccatgcagggttatgcctacattttgacgcaccccggcattccatgcgttttctggaatgattggcgttgggacttccgttcggaaatcaatcaactgatcgccatccgcagggcccaaggcatcaacgatggcagcagcctcagcatccaggttgccgatggcagccgctacggggcgatcatcaatggaaacacggcggtcaagattggtcctggaaactggagcccaagtggtagttggacgctggctgccgccggaaccaattacgccgtctggacaaacggtggcggaacaccaacgccaacacccacaccaaccccaactcagggccccacaacggttacttggaatccatccactccgacagccggacaaaatgtgacgatcacttatccttccggccgctcccttgccagttcctccaacgtcaacctctactggggtgtcaatggatggaccaatgtccaaaccaaagcgatgaccaagaacagttccaatgactggacaaccacgatcacacttccctccaacacaacacgtttgaactttgtgttcaataacggctccagttgggacaacaacagcagtcaggattggaatgtcaacgtgaccgctgtaacgcccacaccaacaccgacaccgactcccacacctacggcaactccgacaccgacacccaccccgacgcccactgccacacccaccccaactccgactccttcgatcatttggtatcgcatcgaagcccgtcacagtggtaaagttctagacgttgccagtgcatcaacttcaaacggtggcaatgtgcatcagtggtcttatgctggtggacagaaccaacaatggcgtgttgtcgacgctgggaacgggtttgtttacatcctaaaccggaacagtggaaaagcacttgaagtgggcaacttctccaccagtaacggcgggaacgtccagcaatgggattatgccggtggttccagtcaacagtggaagctcattgagacgaccaacggatatgtgcaaatccagaatcggaacagcggcaaagccattgatgtttccgctgcttcgactaccaatggtgccaacatccatcagtggacctacggcggcggcaacaatcagcagtggaagctgatcccaatcaattaa

SEQ ID NO: 335 - protein, 686 aa, Unknown
  Obtained from an environmental sample
  SIGNAL (1)...(20)
MVAGFGLYGAALLTPMAAQAETGREVMLQGFNWNSTSQAGGHYNELANRAGEIAGAGIDIVWFPPPSRAADRVGYLPNEWYNMNSNYGNRTTLQAAIGNLRNNGVKTVADIVVNHRVGTTNWADFTNPSFGDNNRAITRDDEWHQSSGNWDTGEAYSAARDLDHTYGPVQNEIKNWLNWLKSDIGFDGWRYDMVKGFSGYYVGEYNTATSPYISVGEFFDYDRQKVVGWINATNARSRAFDFPTRNLLYVAVTQNNYGVLRDGEGKANGLIGWWPQRAITFIENHDTEEARNGEYTPAFPQWATMQGYAYILTHPGIPCVFWNDWRWDFRSEINQLIAIRRAQGINDGSSLSIQVADGSRYGAIINGNTAVKIGPGNWSPSGSWTLAAAGTNYAVWTNGGGTPTPTPTPTPTQGPTTVTWNPSTPTAGQNVTITYPSGRSLASSSNVNLYWGVNGWTNVQTKAMTKNSSNDWTTTITLPSNTTRLNFVFNNGSSWDNNSSQDWNVNVTAVTPTPTPTPTPTPTATPTPTPTPTPTATPTPTPTPSIIWYRIEARHSGKVLDVASASTSNGGNVHQWSYAGGQNQQWRVVDAGNGFVYILNRNSGKALEVGNFSTSNGGNVQQWDYAGGSSQQWKLIETTNGYVQIQNRNSGKAIDVSAASTTNGANIHQWTYGGGNNQQWKLIPIN

SEQ ID NO: 336 - DNA, 1731 bp, Unknown
  Obtained from an environmental sample
atgaccgaacgacacctcagtcgcagggcgaagggggcgttggcgggcctcgccgctgccgccgtcgccgccgtcaccctcgcggctccccccgcagcgcaggcatcgccccccgggaacaaggacgtcaccgctgtcctgttctcgtggaacttcgactccatagcccgggagtgcaccgaccgcctgggccccgccggctacggcttcgtccaggtctcaccgccccaggagcacatccagggctccgcgtggtggacccagtaccagcccgtcagctaccggctggagagcaggctcggcaaccgcgcccagttccggaacatggtcgacacctgcaacagcgcgggtgtgggcgtggtcgtcgacaccgtcatcaaccacatgaccgcggggtccggcaccggcaccggcggttcgcagtacagcaagtaccactaccccgacgccccttacagcgacggggacttcaacgactgccgccgcgacatcagcaactaccgcgaccggtacgacgtccagaactgcgaactggtcggcctcgcggacctgcggaccggcaaggagtacgtccgccagcgcatcgccgactacatgaacgacctgctgtcgctgggcgtcgccggcttccgtatcgacgccgccaagcacatgcccgccgacgacctgcgggccatcagggccaagctgaacaacccggacgcctactggaagcaggaagtcatccatggcgccggcgaggccgtccagcccgaggagtacctcggcgccggcgacgtccaggagttccgctacgcgcacgacatgaagcgcatgttccagcaggaacgcatcgcccacctgcggaccttcggcgagagctggggcttcatgcccagctcgcagtcggcggtcttcgtcgacaaccacgacaccgagcgcaacggcaccaccctcagctacaaggacgggtcggcctacacgctcgccaacgtcttcatgctggcctggccctacggctccccggacgtccactccgggtaccggttcagcaacttcgacgcgggccctcccggcaacggccaggtgagccagtgctggcagaacggctgggagtgccagcacgcctggcccgagatcgagtccatggtcgccttccgcaacgccacccgcggccagcaggtcaccaactggtgggacaacggcaacaacgtcatcgccttcggccggggcagccagggctacgtggcgatcaaccgggagagcggaccggtcacccgcaccttccagacctccctggccgccggtgactactgcgacgtccagtccgggtccacggtcaccgtgaacggctcggggcagttcaccgccaccgtggccggcggaaccgcgctcgccctgcacaccggcgcccggaactgcaccggcaacggcggcggcaccccccaggagccggtggacggcggcgtctccttcgccgtcaacgcctccacgcagtggggcgagcacctctatgtcaccggcaaccgccccgaactgggcaactgggacccgcagaacgccgtccggctcggctcggacgactacccggtctggaaggccgaactggcgatgcccgccgacacctccttccagtacaagtacctgcggcgcaccgacggcggaaccgtgacctgggagcagggcggcaaccgcaccgcgaccgtcccggcctccgggaccctgcggctgaacgacacctggcgcagctag

SEQ ID NO: 337 - protein, 576 aa, Unknown
  Obtained from an environmental sample
  SIGNAL (1)...(35)
MTERHLSRRAKGALAGLAAAAVAAVTLAAPPAAQASPPGNKDVTAVLFSWNFDSIARECTDRLGPAGYGFVQVSPPQEHIQGSAWWTQYQPVSYRLESRLGNRAQFRNMVDTCNSAGVGVVVDTVINHMTAGSGTGTGGSQYSKYHYPDAPYSDGDFNDCRRDISNYRDRYDVQNCELVGLADLRTGKEYVRQRIADYMNDLLSLGVAGFRIDAAKHMPADDLRAIRAKLNNPDAYWKQEVIHGAGEAVQPEEYLGAGDVQEFRYAHDMKRMFQQERIAHLRTFGESWGFMPSSQSAVFVDNHDTERNGTTLSYKDGSAYTLANVFMLAWPYGSPDVHSGYRFSNFDAGPPGNGQVSQCWQNGWECQHAWPEIESMVAFRNATRGQQVTNWWDNGNNVIAFGRGSQGYVAINRESGPVTRTFQTSLAAGDYCDVQSGSTVTVNGSGQFTATVAGGTALALHTGARNCTGNGGGTPQEPVDGGVSFAVNASTQWGEHLYVTGNRPELGNWDPQNAVRLGSDDYPVWKAELAMPADTSFQYKYLRRTDGGTVTWEQGGNRTATVPASGTLRLNDTWRS

SEQ ID NO: 338 - DNA, 1704 bp, Unknown
  Obtained from an environmental sample
atgccgcaccaatacaactacaggccgaaaatacaccgattattttcaggtgctccaatgcaaacaaacaagaaaaccttcctggcgcattgccttcgccaaagtctggtcgcccttggcgccttctcactatcctgtagcctgcaagccaattcattgccgcagatcccggcagagcaggtcaacaataccatgtatcagatgttctactgggatgcctatcccggactttgggccgatctgccagccatggcggaaccattggctgaacgggggatcacctccatgtggctgccgccggcggcaaaaggcatgaatggcaccaacagcgttggctacgatgtctatgacttctgggatctgggcgaattctaccaaaaagggaccatcgccacccgttacggcacccgccagcagctggaccaggcgctgagtgctctggatcaactgggtgttcaggcctattttgatgtggtctttaaccaccgcatgggcgccgatgcccaggaatacattcctggctatggactggcctggaccgagtaccagctgcagggtcggcaggtgcattatacccagcaaaactggggctatttgtggcacgactttgactggaactggaccgcgtttaatggctccgacaatcagttgtatcctggtaaatggtggggcaataccttccacttcccttatttgatgggcgaggatgtcgattacaaccgctttgaagtgcagcaggaaatgaaagcctggggggagtggatcatcaacagcgttggctttagcggctttcggatggatgccatcgcccatgtcgataccgattttacccgtgactggatcaatcacgtgcagtgggccaccagtgaggatgtgttctttgtcgctgaagcctgggtcagcgatatcaacggctatctggatgccgtcaatacgccgcatttgcgcgcttttgatttcaatttgcgcgaagactttgttgctttaagcagtggcagcaaagacatgcgctggtggggtggtctggtcaatagccagcaccgtgatcgggcggtcacctttgtcgataaccacgataccagccgggccggcaacccttatggcatgccgcaggtgatcaactacaagaaccaggcctacgcttacattctgttgcgtgagcatggggtgccgaccgtgtttgcccgcgattacgacgaatttggcatggcgccaacgctggataaactgattgaagcgcgccgttactttgcctatggccctggccatgagtactccggcaatactgaagccgtctatgcctatgtgcgcgaggggctaagtactgtgccgggcaccggtttggtgatgctgatgtcgggtcgtaactggggtggtcagcagtcgttcaccatcaacagccaccagccgaataccaccttttacgattacaccggcaatgtcagtggcaccgtaaccaccaatgcgcagggctatggcagcttcccggtcaatatgacggaaagtaccggttggtcagtctgggtaccacaatccattggtggcactcagccgggaaccattaccctgcggatgaccaaggatgttggctatggcttttcactgttcttcaccggcagcagtgcggagctgaccaattggggcggcggtgttgaaggcacctggacatccggtaatgtgtgggaagtgaccatcccggatcca

SEQ ID NO: 339 - protein, 568 aa, Unknown
  Obtained from an environmental sample
  SIGNAL (1)...(50)
MPHQYNYRPKIHRLFSGAPMQTNKKTFLAHCLRQSLVALGAFSLSCSLQANSLPQIPAEQVNNTMYQMFYWDAYPGLWADLPAMAEPLAERGITSMWLPPAAKGMNGTNSVGYDVYDFWDLGEFYQKGTIATRYGTRQQLDQALSALDQLGVQAYFDVVFNHRMGADAQEYIPGYGLAWTEYQLQGRQVHYTQQNWGYLWHDFDWNWTAFNGSDNQLYPGKWWGNTFHFPYLMGEDVDYNRFEVQQEMKAWGEWIINSVGFSGFRMDAIAHVDTDFTRDWINHVQWATSEDVFFVAEAWVSDINGYLDAVNTPHLRAFDFNLREDFVALSSGSKDMRWWGGLVNSQHRDRAVTFVDNHDTSRAGNPYGMPQVINYKNQAYAYILLREHGVPTVFARDYDEFGMAPTLDKLIEARRYFAYGPGHEYSGNTEAVYAYVREGLSTVPGTGLVMLMSGRNWGGQQSFTINSHQPNTTFYDYTGNVSGTVTTNAQGYGSFPVNMTESTGWSVWVPQSIGGTQPGTITLRMTKDVGYGFSLFFTGSSAELTNWGGGVEGTWTSGNVWEVTIPDP

SEQ ID NO: 340 - DNA, 1848 bp, Unknown
  Obtained from an environmental sample
gtgaaacctgtcacccctacccgcacgggcgagtcaggaatcagctaccagttgctggtttactcgttctgcgactccgacggtgacggtaccggtgatttcaagggaatcgaaagcaagctggactatctcaaggagatgggtgtacaggctttatggctgtcaccaatccatcctgcaacatcctatcacggctatgacgtggaggactacagttcggtaaatccagcctacggcacggaggcggatttcgagtccctgctgaaagcggcgcactcgaaaggaatgaaaatctaccttgatttcgtgctgaaccacacatccaaggaacatccgtggttccttgagggaaagtccgatccggacagcaggtaccgacactattaccatttctccacgacggccaaggacggatattcgcagaccgtttcgggcaccgacccagggaaaatcaacgtgaagttcacccttaaatgcaattcttccggcacacctcagacgcttaaggccgaaagggtggagagcgcggtcaacgagggcactccgaattccggaaaatacctctggtacggttccgtgaccgaaagcacaatgccggaattctattctgccggcgaggacacatatacccttgcaatagaaaacttcgaaaccgactggggcgtactggtacgcaccagcaagactgaatggggcgcaaagaaattcggcgcccaatccgagagcgcccagatgttcgtatggggcgttccgcttaatctgaaatcaaattccgactacgacatactgatgccttggatgggcaagatctggtatcagtccgtattcggctcatatatgccggacctgaattacggtgcggccgccagctgcgaggaatcagaagccttcaaggaagtctgcgcagctgctgacaaatggataaaaatgggcgttgacggcttccgtctcgacgccgtcaagcacatatatgacaacgagaactccgacgagaacccgaccttcctgaagaaattctacgaccattgcaataccacctataaggctgcaggtcattcaggaaatatctatatggtcggggagcaatggagtgaaccgaattatgtcacgccatattacaagggcctcaacgctttcttcgagtttgccttctgctggcgtctgaccgatgccataaacggggccaaaggcgcaggcttcgcctccaccattgacggttatcaccagaaatatactgcgacacgctccgatgccattgcagccacgaaactctcaaaccacgacgaggaccgtatcgcctcaaccctcggccgcaacgcaagcaagcttaagctggccgcggcggtacttcttaccgccggtggtgaaccatatatctaccagggcgaagagcttggttactggggcacgaaaagcaatggggacgaatatgtccgcaccccgatattgtggacggctgacgcaggcagcgcagccgcgggcgcactgaacggcaagatcgacaggaatatgctgacgtcagacatttccgtggaggcccaggccggcaaccaggattctatgcttggcgtttaccgcaaattcggcgtactccgcgactgttacaaagctctcgcgaaaggcagcttccaggaaaagaacggaatcagcaaccaggccatctgcgcctggtatcgcgaatacgatggccagaagattcttgtagtccacaatttcagcgcggcacccgtcactttcgcgccggcaggagacaagctttcggcaatgataggctcaaacggaagcgcgacggtaaagaacgacaacttgacccttggaggttatgcctccgctcttttcctccaataa

SEQ ID NO: 341 - protein, 615 aa, Unknown
  Obtained from an environmental sample
MKPVTPTRTGESGISYQLLVYSFCDSDGDGTGDFKGIESKLDYLKEMGVQALWLSPIHPATSYHGYDVEDYSSVNPAYGTEADFESLLKAAHSKGMKIYLDFVLNHTSKEHPWFLEGKSDPDSRYRHYYHFSTTAKDGYSQTVSGTDPGKINVKFTLKCNSSGTPQTLKAERVESAVNEGTPNSGKYLWYGSVTESTMPEFYSAGEDTYTLAIENFETDWGVLVRTSKTEWGAKKFGAQSESAQMFVWGVPLNLKSNSDYDILMPWMGKIWYQSVFGSYMPDLNYGAAASCEESEAFKEVCAAADKWIKMGVDGFRLDAVKHIYDNENSDENPTFLKKFYDHCNTTYKAAGHSGNIYMVGEQWSEPNYVTPYYKGLNAFFEFAFCWRLTDAINGAKGAGFASTIDGYHQKYTATRSDAIAATKLSNHDEDRIASTLGRNASKLKLAAAVLLTAGGEPYIYQGEELGYWGTKSNGDEYVRTPILWTADAGSAAAGALNGKIDRNMLTSDISVEAQAGNQDSMLGVYRKFGVLRDCYKALAKGSFQEKNGISNQAICAWYREYDGQKILVVHNFSAAPVTFAPAGDKLSAMIGSNGSATVKNDNLTLGGYASALFLQ

SEQ ID NO: 342 - DNA, 2061 bp, Unknown
  Obtained from an environmental sample
atgaaaacactccccaaactcatgtttgtttttttgttgcacccattaatttctatttctgcaaatgcgcaaaccactttcgttcatttatttgaatggcagtggaatgacattgccgctgaatgcgaaaacgttttgggcccaaaaggttatgccgcagtacaagtatcgccaccgcaaaaatcagttgaaggaagcttttggtggacacgctatcaacctgttagttattcgattgaaggacgttcgggaacacgcaccgaatttgcaagtatggtttctcgatgcaaagcagtgggtgtcgatatttatgtcgatgccgttatcaatcacatggctgctggcaaccgcaattttcctgaagttccctatggcgtgaatgactttcatacctgcaccggcaatattgattacaccaacgcatggcaagtacaaaattgcgatctggttggactgaatgatttaaaaaccgaatccgattatgtacgcggaaaaattgccgcttatatgaatgatctgttgagcatgggtgtggcgggtttccgcattgacgcagcgaaacatatcgccagcgcagatatcgccaatatcgtcagtcgactaaatggcaatccctatatttttcaagaagtcataggcgcagcgaatgaacccattacaccagcgcaatacacatatattggtgatgttactgaatttaattttagtaatacgcttgggaattattttaagggtcgcgcacctctaaaagatttacgcaatataggcgtatggagtggctggttagccagtagtgatgcagtcactttcgtagccaaccacgacaatcaacgacaaaacaccagtaatattgtgactcacaaagatggcatgaatgtgaacaacattgcgcacgtttttatgctggcatttccttacgggtacccaaaagttatgtccagttatgactggactaatcacgatcaaggcccgccaaccactggcgcaagcaactgtaataatggctggttatgcgagcaccgcaatcgcgaaattgccaatatggtgggctttcgcaacaccactaaagatgccttttatctttccaattggtgggacaacggcgcgaatcaaattgcttttggtcgcggcaatttaggttttgtggtgatcaatggcgaaagcagcagcatgaacgtcaccttacaaaccggtttagccgcgggtagttattgcaacgtgattagtggtgattttgctaacggaacctgcacgggtgccagcattactgttgcagctaatggcactgcgacatttaatgtagcggcgaagagtgcagcagcaattcatataaacgcaaagaatggcgatatcaccggaaacaattgtgtttatacatcgatgaaattgcgcgggacttttaacaattggggcagtagcgacatgatctgcaacgcgggtatttggatgggtagcgccaccttctcgggcagcagcactgatcgctttaagtttgatgcttacggtaattgggtcaccaattggggaaacaacaataatgatttaattgccgatgctggcggtaatgatattgctgtcaccaccgccgctacttatgcgatcacatttaacgatgcaaatctacaatattcggttaccccaaccaatagcacgagcagtatcgccaccagttcaccggcgagctcaagcagtgtgataagttcaagtagctcgatgagttcaagtagcgctacaaattcgagtgttgcatccagctccgctgccacaactgttagcgtgaacttcacttgccaaaatggcacaacctattcaggacaaagtgtgtatgtggtcggcaataactccaccttaggtaattggactccagcatccgcaatcaaactcgagccaaccagctatccaatctggaccggaacgattcaattgccgagtaacactgcggttgaatggaaatgcctaaaacgcgaagaaaataatgcagccgctggtgttgtgtgggagagcggcagtaacactacttttaataccggtagcacgaccagtaccgttggtgcgttttaa

SEQ ID NO: 343 - protein, 686 aa, Unknown
  Obtained from an environmental sample
  SIGNAL (1)...(23)
MKTLPKLMFVFLLHPLISISANAQTTFVHLFEWQWNDIAAECENVLGPKGYAAVQVSPPQKSVEGSFWWTRYQPVSYSIEGRSGTRTEFASMVSRCKAVGVDIYVDAVINHMAAGNRNFPEVPYGVNDFHTCTGNIDYTNAWQVQNCDLVGLNDLKTESDYVRGKIAAYMNDLLSMGVAGFRIDAAKHIASADIANIVSRLNGNPYIFQEVIGAANEPITPAQYTYIGDVTEFNFSNTLGNYFKGRAPLKDLRNIGVWSGWLASSDAVTFVANHDNQRQNTSNIVTHKDGMNVNNIAHVFMLAFPYGYPKVMSSYDWTNHDQGPPTTGASNCNNGWLCEHRNREIANMVGFRNTTKDAFYLSNWWDNGANQIAFGRGNLGFVVINGESSSMNVTLQTGLAAGSYCNVISGDFANGTCTGASITVAANGTATFNVAAKSAAAIHINAKNGDITGNNCVYTSMKLRGTFNNWGSSDMICNAGIWMGSATFSGSSTDRFKFDAYGNWVTNWGNNNNDLIADAGGNDIAVTTAATYAITFNDANLQYSVTPTNSTSSIATSSPASSSSVISSSSSMSSSSATNSSVASSSAATTVSVNFTCQNGTTYSGQSVYVVGNNSTLGNWTPASAIKLEPTSYPIWTGTIQLPSNTAVEWKCLKREENNAAAGVVWESGSNTTFNTGSTTSTVGAF

SEQ ID NO: 344 - DNA, 1980 bp, Unknown
  Obtained from an environmental sample
atgaaaaaactattaattaccttgttaatttttcctggttttttattctctttttctgctgttgcacaaaccacctttgtccatttgtttgagtggcagtggaatgcaattgccagtgaatgcgaaaaccatctcggcccaaaaggttatgcggcggtacaagtatcaccgccacaaaaatctatcagcggcaaccaatggtggacacgctaccaaccggtcagctattccattgaaggccgtttaggaacccgcgccgaattcgccagcatggtttcacgctgtaacgcagtgggagtggatatttatgtagacgcagtcatcaatcatatgtccgccggcaaccgcagttttcccgaagtacctttcggcaccaacgactttcatacttgcaccagcgacattgactacagcgatgtctggtctattcaaaattgcgatctggtgggtctgaatgatttaaaaacagagtccgattatgtacgcggaaagatcgccgactatatgaatgatttaatcagccttggcgtaaccggttttcggattgatgcggccaagcatatgcccagcagtgatattgccaacatcgtcagccgtttaaatggtgacccttatatttttcaggaagtgatcggtgctggcggtgagccaatccaaccgagccagtacacctatgtcggtgacgtaacggaatttaatttttccaatacgctgggtcattattttaaaggccgagccacattgcatgagctacgcaatatcggtgtgtggagcggatggctgaacagtgcagatgcgattacgtttgtcgccaaccatgataaccagcggcaaaataccaataacatcatcactcacaaagacggcatgaatctaaataatattgcgcacgtttttgcgctggcctggccttacggttatccgaaagtaatgtccagttatgactggaacgatcacgaccaaggcccgccaaccaatgctgctaacacctgttctaacggttggctgtgtgaacatcgcaatcgcgaaatcgctaatatggttggcttccgcaatgccacgcaaagcgcattctatgtttccaattggtgggacaacggcgcgaatcaaattgcttttggtcgcggcgatcgcggttttgtggtgatcaatggcgaaagcggcggcaccttgaataccactttgcaaactggcctggctgccggtacctattgcgatgtgatcaagggtgatttttctaacggcgtatgtaccggtccgaccattaccgtcggtgccgacggcaatgcgagttttgctgtcggatccaaaggtgcttcggctattcatgctgacgctgtagtcggtccgattaccggcaatgaatgcgtttacgacaccatgaatttacgcggcacatttaacagctgggaatcacacgccatgacatgtgccaatggtatctggatcggcagcgccaacttttccggcaacagcaatgaacgattcaagtttgacgtctatggtgattggcaaaccaattttggtgacgccaataacgatggtgttgccaatctcggcggcgcggatatcgcgatagcctctgccggtgattacaccatcacctttaacgatgcgagctttgcttatacctttaccccggcaaccagcagcagctcaagttcgaattccagcagcacacccggtactgtggcggtgaatttcacttgtgaaaatggcagtacttatgtgggacaaagtgtttatgtggtgggtaacaatgcagccatcggcggttggtctccaacgaacgcggtaaagcttaatcccgtcagttatcccacctggaccggcacgattcaattaccggcgaacacagctattgaatggaaatgtttgaagcgagaagaaaataatcctgcagcgggtattgagtgggaagcaggtggaaataatagtctaaatacagggagcgatgcgaatacgacgggcgggttttga

SEQ ID NO: 345 - protein, 659 aa, Unknown
  Obtained from an environmental sample
  SIGNAL (1)...(22)
MKKLLITLLIFPGFLFSFSAVAQTTFVHLFEWQWNAIASECENHLGPKGYAAVQVSPPQKSISGNQWWTRYQPVSYSIEGRLGTRAEFASMVSRCNAVGVDIYVDAVINHMSAGNRSFPEVPFGTNDFHTCTSDIDYSDVWSIQNCDLVGLNDLKTESDYVRGKIADYMNDLISLGVTGFRIDAAKHMPSSDIANIVSRLNGDPYIFQEVIGAGGEPIQPSQYTYVGDVTEFNFSNTLGHYFKGRATLHELRNIGVWSGWLNSADAITFVANHDNQRQNTNNIITHKDGMNLNNIAHVFALAWPYGYPKVMSSYDWNDHDQGPPTNAANTCSNGWLCEHRNREIANMVGFRNATQSAFYVSNWWDNGANQIAFGRGDRGFVVINGESGGTLNTTLQTGLAAGTYCDVIKGDFSNGVCTGPTITVGADGNASFAVGSKGASAIHADAVVGPITGNECVYDTMNLRGTFNSWESHAMTCANGIWIGSANFSGNSNERFKFDVYGDWQTNFGDANNDGVANLGGADIAIASAGDYTITFNDASFAYTFTPATSSSSSSNSSSTPGTVAVNFTCENGSTYVGQSVYVVGNNAAIGGWSPTNAVKLNPVSYPTWTGTIQLPANTAIEWKCLKREENNPAAGIEWEAGGNNSLNTGSDANTTGGF

SEQ ID NO: 346 - DNA, 1398 bp, Unknown
  Obtained from an environmental sample
atgaaaaaaacagcgggaatctgggtgatcgcaggcatgctgatcgcccctctggcacacgccgacgtcatactgcacgccttcaactggcaatacagcgaagtcaccgccaaggccgatctcatcaaggccgccggctacaagcaggtgctcatctcgccgcccctcaaatcatcgggcaacgagtggtgggcacgctatcaaccgcaggatctgcgcctcatcgatactccccttggcaacaagcaggatctcgagcagctgatcgccgccatgcaggcacgaggcatagccgtctatgccgatattgtgctcaaccacatggccaacgagagctggaagcgcagcgatctcaactaccccggcagcgagctgctcggccagtatgcggccaaccccgcctacttcgaacgccagaagctgttcggcgatctcggccagaacttgctggccggatcggattttcaccccgaaggctgcatcaccgactggagcgatccgggccacgttcagtactggcgcctgtgtggcggcgccggtgacaaggggctgccggatcttgatcccaacaactgggtagtgagccagcagcaggcttatctcaaggcgctcaaggggatggggatcaagggctttcgggtcgatgcggtcaagcacatgagcgattaccagatcaatgccgtgttcaccccagagataaaacagggcatgcacgtctttggcgaggtaatcaccacggggggcgccggcagcacggattacgaacgcttccttaaaccctatctcgacagcagcggtcagggggcctatgactttccgctgtttgcctccctgcgcggggcgctgggttatggcggcagcatgagcctgctggccgaccccggtgcctacggtcaggccctgccgggcagccgcgccgtcaccttcgccatcacccacgacattcccaccaacgatggctttcgctaccagatcctgaaccagaccgacgagaagctggcctatgcctacctgctcggtcgcgatggtggctcgccgcttgtctattccgatcacggcgagacccaggccaaggatgggctgcgctggcaggattattaccagcgcgcggatctcaaaggcatgatccgcttccataacgcgctgcagggccagcccatgcaactggtcggcagcggcgactgcttcgtgctgttcaaacgtggcaagcaggggctggtcggtgtcaacaagtgcgagtacgagcaagagttctggctcgataccgccaaattcgagatgaactggtatcgcaactaccgggatgtgctcgatcaaaacgccgtcatcaatgtgcagagccagtgggtgcgggtcgccattcccgcccgcagcgcccggctctggctgcaagaataa

SEQ ID NO: 347 - protein, 465 aa, Unknown
  Obtained from an environmental sample
  SIGNAL (1)...(21)
MKKTAGIWVIAGMLIAPLAHADVILHAFNWQYSEVTAKADLIKAAGYKQVLISPPLKSSGNEWWARYQPQDLRLIDTPLGNKQDLEQLIAAMQARGIAVYADIVLNHMANESWKRSDLNYPGSELLGQYAANPAYFERQKLFGDLGQNLLAGSDFHPEGCITDWSDPGHVQYWRLCGGAGDKGLPDLDPNNWVVSQQQAYLKALKGMGIKGFRVDAVKHMSDYQINAVFTPEIKQGMHVFGEVITTGGAGSTDYERFLKPYLDSSGQGAYDFPLFASLRGALGYGGSMSLLADPGAYGQALPGSRAVTFAITHDIPTNDGFRYQILNQTDEKLAYAYLLGRDGGSPLVYSDHGETQAKDGLRWQDYYQRADLKGMIRFHNALQGQPMQLVGSGDCFVLFKRGKQGLVGVNKCEYEQEFWLDTAKFEMNWYRNYRDVLDQNAVINVQSQWVRVAIPARSARLWLQE

SEQ ID NO: 348 - DNA, 1488 bp, Unknown
  Obtained from an environmental sample
atgtctgaacttaatggtgtaatgatgcaatacttccactggtatagcgctgctgacggcagcctatggcagcaagtggcagagaaagcagaggaattagctgcggtgggggtcacgtcgctctggttgccgcctgcctacaagggaaccgggggcggttatgatgtgggctacggcgtttatgacctgtttgatctgggtgagtttgaccaaaaaggctcggtgcgcacaaagtatggcactaaggatgaatacctcgctgcgattaagcaggcacaacgtttaggcatcaggatctatgccgatgttgtgtttaaccacaagttgggtgcggatgaagaagaggaagtggaagccacgcccttcaatcctgacaatcgcaatcatacggttggcgactatcagaaaatcaaagcctggacggggttcacttttcccggtcgaggtgacaaatactccagcatgaagtggcattggtggcactttgatgcgatcgactataacgcttacaaacccgaagagaacgctatctacttgctcaagggtaaggagttcgatcgtaacgttgacctcgaaaaaggtaacttcgattacttgatgggatgtgatttagatatggatcatccggaagtgattggagagttgaaatactggggtgaatggtacatcaagacaaccaatgtcgatgggttccggtttgatgccgtaaagcatgtgtctgctgacttctttcgtgaatggttagaccacgttgaacaccatgcgggtagagatgtctttgccgtaggtgagtactggtcctatgatgtcgaggcactacacagcttcatcgaaacaacgaatgggaaagtcacgttgtttgatgccccactccactacaactttcactgcgccagtacctcaggcaacagttatgacatgcgccaaatctttgacggcaccctggtgcagcaacaacctgctctggcagtcaccctggtagaaaaccatgattctcaacccctgcaatcgctggaatccatcgttgaagggtggttcaagcccctggcatatgccttgattttgctgaggcgggaagggtatccctgtattttttatgctgactactacggtgctcactacaaagatcagggcagggatggccaggagtatgagatttggatggacagccaccaattcttgatcgacaaaatgctggttgctcggcaaacctttgcctatggcgatcaatacgattattttgaccacgccaatacgatcggctggacacgcctaggcacagaggagcatcctggaggcatggcggttgtgctcagtaatggcgatgctggcagcaaatacatggaagttgggcagcctaactgcacctatgttgacatcacggaacatattaatgaaccgatcgtcaccaatgccgatggatgggctgactttcgctgtgagcctgggtcagtatcagtttgggttccccaagcagcggcacaatag

SEQ ID NO: 349 - protein, 495 aa, Unknown
  Obtained from an environmental sample
MSELNGVMMQYFHWYSAADGSLWQQVAEKAEELAAVGVTSLWLPPAYKGTGGGYDVGYGVYDLFDLGEFDQKGSVRTKYGTKDEYLAAIKQAQRLGIRIYADVVFNHKLGADEEEEVEATPFNPDNRNHTVGDYQKIKAWTGFTFPGRGDKYSSMKWHWWHFDAIDYNAYKPEENAIYLLKGKEFDRNVDLEKGNFDYLMGCDLDMDHPEVIGELKYWGEWYIKTTNVDGFRFDAVKHVSADFFREWLDHVEHHAGRDVFAVGEYWSYDVEALHSFIETTNGKVTLFDAPLHYNFHCASTSGNSYDMRQIFDGTLVQQQPALAVTLVENHDSQPLQSLESIVEGWFKPLAYALILLRREGYPCIFYADYYGAHYKDQGRDGQEYEIWMDSHQFLIDKMLVARQTFAYGDQYDYFDHANTIGWTRLGTEEHPGGMAVVLSNGDAGSKYMEVGQPNCTYVDITEHINEPIVTNADGWADFRCEPGSVSVWVPQAAAQ

SEQ ID NO: 350 - DNA, 2001 bp, Unknown
  Obtained from an environmental sample
atgaaactttcacacctagctgcagcgttgctgctggcttcgtcgagtactgcctctctcgcggcttccccgactacgtttgtccatttatttgagtggcgttggagtgatgttgcgcaggagtgcgaaacatttttagggccaaatggttttgccgcagttcaagtgtctccgccaaacgagcacattcagggttcgcagtggtggacccgctatcaaccagtgagttatcaactcgagagtcgtggtggtagccgtgccgcatttatcaacatggtgcaacgttgtaatgctgcgggggtgtcaatttatgtcgacgccgtgatcaaccatatggccaatggcagtggcgttggtaccgccggcagtaattacggcaaccgccaatatccaatttactcaggccaagatttccatgcttcttgtgcgattaatggctctgattacggcaataatcgttggcgtgtacagaattgcgaactctcaggtttaccagatttaaatactggctcgccttatgtgcaaaacacaatcgccgcttacatgaatgaactgaccagcttaggggtaaaaggcttccgtttggatgcagctaagcatatgtcggttgaagacattgcggcaatccgcggcaagctgacaggcgcgccgttaatttatcaagaagtgatagaccaaggtggcgaagcaattagctcaagtgagtacacaggtcagggcttagttatcgagtttaaatacagtacccagctcggcaacgtatttaaaactggccgtttagcctctctacgcaattttggcgaaggttggggctttttaccaagcagtcgcgccgtagtttttgtggataaccatgataaccaacgcggccatggcggtgcgggcaatgtagtgacctacaaagacggccggatgtatgacttagccaacgtgtttatgctggcttacccctacggctatacccaagttatgtcgagttatgactataaaggcgataccgacgctggcggtcctggcattccggtccatcaaaatggtcagttgaactgttttggcactgactggaagtgtgagcatcgttggagttatatcgcaggggcagtgcaatttcgcaacaacactgttaatgaatggcgcgtcaccaattggtgggacaacggcaacaaccagattgcgtttggtcgtgctgctgctggttttgtcgcgatcaacaaagaaagttatgcattaaataccagcttggcaaccagtatggcgccaggtcagtattgtaacgtgctcaaaggtaaacgcagcagtgaccaaaaatcttgtacaggtgaggtgattactgtgggtggcgacggtcggatccaagcgaatgtcgccgcttgggatgcgtttgcgattcatcaagatagcaaattgacgactggcggcggtacgccgggcgcggattggcagcgcactgtggtgtttatccaagcacagactctgagtggccaagatatgtttgtccgcggtggtcttgatcatcaagtggcactgaaccaaaaaggtttaagttgcaccgcgacgaacttcttgtgtgcaatgcctattcgccatcggaatctgaaaaacgcgactacagcgccatggaaagccaacgacaattacctcgattggtacgggcgtgaagcaagtcaaagcgcaactgcagaaggtacgccgctcgattggaccactaatctttggccaaatagttggggcacattacgcacagtgccggtggatggttatggtcaagaagcccttaacacgtttggccaacattactggatgatggatgtagatatggactgcagcaaaaccctcaacggttggtttgaactgaaggcttttgtgaaaaacggtcaaggttgggaaggcgatatcagccaagcaaatccaccttacgcgaccaaaaaccatttagcgcaatgcggcaaactaaacaagtttgaatttggcagctcggcggcattcatcaccaacttgtaa

SEQ ID NO: 351 - protein, 666 aa, Unknown
  Obtained from an environmental sample
  SIGNAL (1)...(21)
MKLSHLAAALLLASSSTASLAASPTTFVHLFEWRWSDVAQECETFLGPNGFAAVQVSPPNEHIQGSQWWTRYQPVSYQLESRGGSRAAFINMVQRCNAAGVSIYVDAVINHMANGSGVGTAGSNYGNRQYPIYSGQDFHASCAINGSDYGNNRWRVQNCELSGLPDLNTGSPYVQNTIAAYMNELTSLGVKGFRLDAAKHMSVEDIAAIRGKLTGAPLIYQEVIDQGGEAISSSEYTGQGLVIEFKYSTQLGNVFKTGRLASLRNFGEGWGFLPSSRAVVFVDNHDNQRGHGGAGNVVTYKDGRMYDLANVFMLAYPYGYTQVMSSYDYKGDTDAGGPGIPVHQNGQLNCFGTDWKCEHRWSYIAGAVQFRNNTVNEWRVTNWWDNGNNQIAFGRAAAGFVAINKESYALNTSLATSMAPGQYCNVLKGKRSSDQKSCTGEVITVGGDGRIQANVAAWDAFAIHQDSKLTTGGGTPGADWQRTVVFIQAQTLSGQDMFVRGGLDHQVALNQKGLSCTATNFLCAMPIRHRNLKNATTAPWKANDNYLDWYGREASQSATAEGTPLDWTTNLWPNSWGTLRTVPVDGYGQEALNTFGQHYWMMDVDMDCSKTLNGWFELKAFVKNGQGWEGDISQANPPYATKNHLAQCGKLNKFEFGSSAAFITNL

SEQ ID NO: 352 - DNA, 1263 bp, Unknown
  Obtained from an environmental sample
atgctcaagaagaaggtgcttggcggagttctgtccctgtcgtgggccctgggtctggtggcgtcgacggccgcgtccgcgggtccgctggatggcaacagcagcgacgtgatgctgcagggcttccactggcggtccaccgagacgtacccctggtggggcgtcatccagggcaaggcctcggacatcaaggccagcggcttcaccatggtgtggttcccaccctccggggactcggcggccaatgagggctacctgccgcggcagctctacgtgcagagcagtaagtacggcacggacgcgcagctcaagagcgccatcggctcgctgcacacctacggggtgaaggccatcgcggacatcgtggtcaaccaccgcgtgggcaccaccaactgggcggacttcaccaaccccacctggggctcgtggtcggtggtgaagggcgacgagtggacgagcgccaccggcaactacgacaccggtgatggcttcagcgccgcgcgcgacctggaccacacgaacggcaccgtgcagagcgacctgaagggctggatgaactggctcaagtccagcatcggctacgacggctggcgctatgactacgtgaagggctacggcggctcgtacgtgggcggctacaacagcgccacggtgccctacttctccgtgggcgagctgtggacggacctcaacctcaacgacgtcaacccgcaccgccagctcatcatgaactggatcaacgccaccgggggcaactcgggcgcgttcgacttcaccaccaagggcatcctccagcaggcggtgcagtacaacgagttctggcggctcaaggccagcgatggaaagccccagggcgccatcggctggtggccggccaggtcggtgacgttcatcgacaaccacgacaccggcccgagccacccgagcggcggccagaaccactggcccttccccagcgacaaggtgatgcagggctacgcgtacatcctcacgcacccggggattccctgtgtctactgggtgcacttctatgactggggccacgcagcggccatcaagagcctcatcgcggcgcgcaaggagaagggcgtcacctccacgtccgcggtgaacatcgtggccgcggacacgagcaagtacgccgccatcatcaccggcaacacgggcagcctggcgatgaagattggtgtcggcgcctggtcgccgggcacgggctggacgctggtgaactccggcaccaactgggccgtctggaagcagtag

SEQ ID NO: 353 - protein, 420 aa, Unknown
  Obtained from an environmental sample
  SIGNAL (1)...(27)
MLKKKVLGGVLSLSWALGLVASTAASAGPLDGNSSDVMLQGFHWRSTETYPWWGVIQGKASDIKASGFTMVWFPPSGDSAANEGYLPRQLYVQSSKYGTDAQLKSAIGSLHTYGVKAIADIVVNHRVGTTNWADFTNPTWGSWSVVKGDEWTSATGNYDTGDGFSAARDLDHTNGTVQSDLKGWMNWLKSSIGYDGWRYDYVKGYGGSYVGGYNSATVPYFSVGELWTDLNLNDVNPHRQLIMNWINATGGNSGAFDFTTKGILQQAVQYNEFWRLKASDGKPQGAIGWWPARSVTFIDNHDTGPSHPSGGQNHWPFPSDKVMQGYAYILTHPGIPCVYWVHFYDWGHAAAIKSLIAARKEKGVTSTSAVNIVAADTSKYAAIITGNTGSLAMKIGVGAWSPGTGWTLVNSGTNWAVWKQ

SEQ ID NO: 354 - DNA, 2577 bp, Unknown
  Obtained from an environmental sample
atgcacaacacaatgtttcgaaccgccatgctcgccgcggtgctgggctcattcagccacacagccgccgccgaaggggtcatggtccacctgttccaatggaagttcaacgatatcgccaacgagtgcgagacagtgctcggtcccaagggattcggtggtgtccagatcactccgcccgcagagcacaagcaggggagccaggtctggtggaccgtctaccagcccgtcagcttcaagaacttcaacagcttcggcggcagcgaggcagagctcaggagcatgatcacccgctgcaatgcggccggggtcaaggtctatgccgacgccgtcttcaaccagctggcctcgggcagcgggacagccaccggcggcggcagctacaactcggggcaatatcagtatccccagttcggctacaacgacttccaccacagcggtgacatcaccaactacggcgacagcaacaacgtctggaacggcgccctctacggcatgccggatctcaataccggctctccctacgtgcaggatcagatagccacctacatgaagaccctgctgggttggggcgtggcgggctttcgcatcgatgcggccaagcacatggcccccggcgaggtgaaggccatactcgacaaggcgggcagccccaaggcctacctggaagtgataggcgcaggtggagagtcggcagacatccagccgggtcgctacacctatatcgacactgtcaccgacttcaaatacggcacagatctggccgccaacttcaacggccagatcaagaacctcaagaccctgggcgagagctggggcctgctcccctccagcaaggccttcgtcttcgtggtcaaccacgaccgcgagcgcggccacggtggcggcggcatgctcaccttcatgagcggtgcccgctacgatctggccaacaccttcatgatggcctggccctatggctggaagcaggtgatgtcgggctatcgcttcgagaacatgggcacctatgaaaccgacaagggggcgccgggcagcacaccctgcacagacggccagtggaactgcgagcagcgtcgcccgaccatcatgaacatggccctgttccacaacagaaccgagggtcaagctgtcagtcactggtgggacaacggcaacaaccagatagccttcggccggggagacaaaggcttcgtcgccatcaacaacgagagcggcagcctggtggcctcggtgcagaccggcctgccagcgggcgagtactgcaacctcctcggcggcaatgactactgcagcgggggttatgtcaccgtcgacggcagcggcaaggccagcctgaacgtgccgggcatgaaggccgccgccatcatcgccggctgcaccaaggccaacccctgcggcggcaccgccctgccgggcaacaagttcagcagcatgaacctgcgtggcacccacaacgcctggggcaacacccccatgacagtcgatgccaaccgtgtctggtccgccaccctgaccctgaccggcagcggtgacgccaccggtgcccagcgtttcaagttcgacgtcttcggcaactggaccgagagctacggcgacaacgaaggggacggcatcgccgacaagggcagcagcaaggatatcctggtcagcgggacgggcagctaccgcatcaccctgaacgaaggggatctgcgctatacggtcacccccctcaccagcaaccaggcaccggtcgccgccctctcgcccaaggtcctcagcgtcaagacgggagagagcgtggtattcgatggctccgcctccaccgacgatgaagccgtggcgagctacagctggtctaccggcggcaacgcccccactgagaccgtccagttcgataccccgggcacccataccgtcaccctgacagtcaccgatgccgaggggctgacctccagtgccagcgcaactgtgactgtcaccgacagcaacggcgcctacaacagcgtgctgccgaccctgcacttccgtggcacccccaatggttgggggacgctcgccatgacgctggttgccgacaaccagtgggaggcattggccaccttcaacggccaggccaaccagcgcttcaagttcgacgtcaagggagactggacccagaactacggtgacaccaacaaggatggggtggccgaacaggggggcgccgacatagtgaccccggtcagcggccagtaccgggtgcgcttcaacgaccagaccctgcaatacagcctgaccccggtcagcgtcggctatgccaagaacatcgccagcctgaacatccgtggcaccaccaatggctggggcaccactcccatgacgctggtgggggatcaccagtggcaggccggtgtcaccttcacgggggccggtgatgccagcggcggccagcgcttcaagttcgacgtcaagggtgactggacccagaactacggcgacaccaacaaggacggcgtggccgagctggccggagccgacatcaccaccgcagtggtcggtgcctatgtggtgcgcttcaacgaccagaccctggcctacagcctgagcgcccagtaa

SEQ ID NO: 355 - protein, 858 aa, Unknown
  Obtained from an environmental sample
  SIGNAL (1)...(24)
MHNTMFRTAMLAAVLGSFSHTAAAEGVMVHLFQWKFNDIANECETVLGPKGFGGVQITPPAEHKQGSQVWWTVYQPVSFKNFNSFGGSEAELRSMITRCNAAGVKVYADAVFNQLASGSGTATGGGSYNSGQYQYPQFGYNDFHHSGDITNYGDSNNVWNGALYGMPDLNTGSPYVQDQIATYMKTLLGWGVAGFRIDAAKHMAPGEVKAILDKAGSPKAYLEVIGAGGESADIQPGRYTYIDTVTDFKYGTDLAANFNGQIKNLKTLGESWGLLPSSKAFVFVVNHDRERGHGGGGMLTFMSGARYDLANTFMMAWPYGWKQVMSGYRFENMGTYETDKGAPGSTPCTDGQWNCEQRRPTIMNMALFHNRTEGQAVSHWWDNGNNQIAFGRGDKGFVAINNESGSLVASVQTGLPAGEYCNLLGGNDYCSGGYVTVDGSGKASLNVPGMKAAAIIAGCTKANPCGGTALPGNKFSSMNLRGTHNAWGNTPMTVDANRVWSATLTLTGSGDATGAQRFKFDVFGNWTESYGDNEGDGIADKGSSKDILVSGTGSYRITLNEGDLRYTVTPLTSNQAPVAALSPKVLSVKTGESVVFDGSASTDDEAVASYSWSTGGNAPTETVQFDTPGTHTVTLTVTDAEGLTSSASATVTVTDSNGAYNSVLPTLHFRGTPNGWGTLAMTLVADNQWEALATFNGQANQRFKFDVKGDWTQNYGDTNKDGVAEQGGADIVTPVSGQYRVRFNDQTLQYSLTPVSVGYAKNIASLNIRGTTNGWGTTPMTLVGDHQWQAGVTFTGAGDASGGQRFKFDVKGDWTQNYGDTNKDGVAELAGADITTAVVGAYVVRFNDQTLAYSLSAQ

SEQ ID NO: 356 - DNA, 4875 bp, Unknown
  Obtained from an environmental sample
gtgatgctggttttacaatggtatggttccccccccgtatctgaatcagtggataaccatgggtatcttcccggaaggctgtatgaccttaacagctcaaaatacggcaaccagcagcagctgattgaggctatccaggcgcttaatgcagcggatgttaaagccatggctgatattgttatcaatcaccgctgcggacagtatcagattaacggtaactggcacggatatgaacagccggactggcaggaatgggctgttgttgctaatgatggcggcacgggtgctcaggataccggtgagggatacggtcctgcaccggacatagaccacaccaaccctacagtccaggcggacattatggcctggatgaactggctgcggactacaataggatttgatggctggcgctatgattatgtcagaggcttttccggttactatgtgggtatgtacaacgatgccacacaaccgtatttttcagtcggggaattctggccagatattacagggagttattatgctactgtccctgacttgaactaccaccggcagcagcttgctgactgggtggatgcaacaggtaatgcatcgcacgttattgattttacaaccaagtggcagctccagcttgcttttgagcggacggaattctggcggatgggacaggttcccggtttgattggctggtggccggagcgaagtgtgacgtttattgacaatcatgatacaggttccagcccgggcggagggcagtcgcattgggagtttcctgcggtgcacgtggcggcaggctatgcgtatattcttacacatcccggtgtaccaaaggtgtattggccgcattattttgattggggctcagggctgagaaatactatcagagacctcatggcaatcagactaaataacgggatacattcgggcagcaccattgatgtgcaggttgctgaagcctccagatatgctgccattattgacgggaaggttgccgtcaaaattggcccgggtgactggtcaccgggcggggactggcaccttgcagcgtccgggaatggctttgctgtttggaccaaggatgaaggcggctctgatcgtcaatatgataccatgttcatcaggggcacgtttaataactggggctcaactgcaatgactccgcttggggattcagagtggattgcggtggctgaattttccggtgcttccaatgaccgcttcaagtttgatgcctacggtgactggtctttgaactggggtgacaataacggagacggcgtactcaatcaatttggagaggatattccaattactgagggagccggcagatataccataacgctcaatgaagaaactatggcgtatactgtgacgtttgatggcagtattgatattccagcggcaccttcaggtttaagcgctcaggcaatttcttctgcagctatccgtgtatcctgggcaccagtgtcaggtgctgcttcctatacagtgtacagggctgcatctgctgatgggacatacactgctgtaggtacaacaggatcaacgaactttgatgtttccggtttattcagcgacaggacatattatttccgcgttgctgcttccaatgcagccggcaactctgaacaatctgcatatgtttcggctaccacccccaaagccacaacgattgttcgcgcgttctatacggctgccggcggcaaccgcttatatatacggggtgatatggctccgctaaactggaataccggtgaagaaatgacccgcgtgtctgacggtttatgggaatggcagactgatgcgctttccacggcacgaaatgttaattttaaaattcttatcaatgacagtatctggtcagaaggtgcgatgttcagggtgattggcgggcagacactggaaattcatcccagttttaatcagcctccggcaatacctcaggggctggtaggtcaggctctctcacctttttcagtacggctcaactggcatgccgtttccggcgcggacaggtatattttgtatcaatccactgtttcatggggaaattatatagtagctgcgactactgaggaaaggcaggtagacattgaggggctggatgctgaggctacgtattatttcagggttgcggctgaaaatgactacggcacctccccccgttccacgtttattgctgttactacgcccagcgctgtgcctgctgtaccggcgggactcgaagcagaacctgtttcaggcacgagcatcgctctttcctggggttctgttaccggggctgagacgtatacagtgtaccgtgcagcagctgctgacggtacatatgctgccatcggtactacaagttcggcgaattttgatgcaacaggacttcattcagaccggacatactttttccgcgtggatgcatctaatgaatttggaagatctgcgcaatcctcccctgtttctgcaagtacaccggcggtagtaacgactgtacgtgcccactttgcgtcagctcagggagagaccttatcgctcaggggtgatatggcaccgcttaactgggatactggtgcagcaatgtcgtatcttggtgatggtgtctggcaatggcagactgatgagctttcaactgcgagaaatattaactacaaagttctgctcaatgatacaatatggtcagaaggtgctatgtaccggattattggcggacagattgtggatatttatccgtcgtttaatcagccgcccgctattccctccggcctgcaggcagagacgctttcttcatcagaaatagcaatacactgggatgcggtttcagatgcggactcgtatacagtatatcgttccacggttaactggggtggatatgaggcaatcggtaccactgcggatactgaatttcaggcagtggggcttgccagctctactacgtatttcttccgggtcagcgctgctaatgcatatggggcatccccccgttctgtgtttgtctcggcaactacggaaggggaggttcccggtattccctctagtgtggctgcggaagccttgtctgcatctgcaataaaggtgagctgggataccgccaccggtgctgacgggtatgaggtgtatagatccatctcctcagatggtccgtttacgattgtggcatcgaccagcgaaactacgcacatcgaaaacggccttgcttcagaaactgtatactatttcagggtcaacgcagttaatgaatgggggaactccggattctcttcaacagccagcgcatcaacacttgggacagctccttcagctccctcaggtctgagtttgacggcattgtccggaacctcagtcagggctcagtgggatgcagtttccggtgcggaatattatactgtttaccgttccagcgcggcagacgggtcgtatacagctgccggaacggcgagctctccatctatggatatttccagcctgcatagtgatagaacatattttttccgggttagcgcctccaaccagtggggtgagtcaagtcaatcatcacatgcttcagtgagcacaccggcggtcactacgactgtaagggcgcattattcgccttcccagggtgagggattgtatttgagaggtgatatggcacctctgaactggaatacaggtgtagcaatgacctataccggcgaaggtatctgggaatggcaaacggatgccctgtctacagcgcgtaatattaactataaggtgctccttgatgatgcaacctggtccgagggggcaatgtaccgggtaataggcggccagactgttgatatttatcctgggtttaatacacctcctgctattccgcagaatgtttctgccgatacacagtcttcctctacggttctggtaagctgggatgccgtggatgatacagagtactacagggtttttatgtccaccgtttcctggggagaatattccgaaataggtgttaccggtgataccagcctgcaggctgagggtcttgacagcctcacaacatattatttcagggtaagtgcggtaaatgagtatggcacatctgcgcgttctacatttgtgtcggcaaccacttttggtgtagccccttctgtaccggctaatatcagtgcctctccgctaaccgcttcttccatacgtgtaagctgggatgctgtttccgcagttgaggaataccgcgtgtacatggcggaatcttccggtggcgaatatcagacagccggattgacatctaattcatcttttgacgtttccggcctcaacccggcaaccacatattattttaaagtccgttctttgaatgagtggggctattcaaaccaatccagtgctgtttccgctgctacctatgcccttcctgccaatatcccaacaggccttaccgctgaggctgtttcttcatcggcaatcaatctggtatgggatgctgttgaatatgcagaaacatatacagtataccgttcaacttcagaagatggaacgtatacatctattggcactactgaatccccgtcttttcaggcggataatttaagtgtttccacgcggtactattttaaagtacgcgcggttaatgcccacggcactactgagcagtctgttgctgtgacagcaagaacatttggaacgcctccttctgttcctcaaaatgttgaagcagttgttttatcttctacaagaatcattgtgagttggaattctgttgcagctgctgacgattatattgtttttatcgcggctgattccgccggcccctacgaggaggcaggcattatttcctctacggtatatgaggctgaaaatttgtcagccaaaacaacgtattatttcagagttgctgcggttaatgagtggggtacttccagcgcttct

SEQ ID NO: 357 - protein, 1625 aa, Unknown
  Obtained from an environmental sample
MMLVLQWYGSPPVSESVDNHGYLPGRLYDLNSSKYGNQQQLIEAIQALNAADVKAMADIVINHRCGQYQINGNWHGYEQPDWQEWAVVANDGGTGAQDTGEGYGPAPDIDHTNPTVQADIMAWMNWLRTTIGFDGWRYDYVRGFSGYYVGMYNDATQPYFSVGEFWPDITGSYYATVPDLNYHRQQLADWVDATGNASHVIDFTTKWQLQLAFERTEFWRMGQVPGLIGWWPERSVTFIDNHDTGSSPGGGQSHWEFPAVHVAAGYAYILTHPGVPKVYWPHYFDWGSGLRNTIRDLMAIRLNNGIHSGSTIDVQVAEASRYAAIIDGKVAVKIGPGDWSPGGDWHLAASGNGFAVWTKDEGGSDRQYDTMFIRGTFNNWGSTAMTPLGDSEWIAVAEFSGASNDRFKFDAYGDWSLNWGDNNGDGVLNQFGEDIPITEGAGRYTITLNEETMAYTVTFDGSIDIPAAPSGLSAQAISSAAIRVSWAPVSGAASYTVYRAASADGTYTAVGTTGSTNFDVSGLFSDRTYYFRVAASNAAGNSEQSAYVSATTPKATTIVRAFYTAAGGNRLYIRGDMAPLNWNTGEEMTRVSDGLWEWQTDALSTARNVNFKILINDSIWSEGAMFRVIGGQTLEIHPSFNQPPAIPQGLVGQALSPFSVRLNWHAVSGADRYILYQSTVSWGNYIVAATTEERQVDIEGLDAEATYYFRVAAENDYGTSPRSTFIAVTTPSAVPAVPAGLEAEPVSGTSIALSWGSVTGAETYTVYRAAAADGTYAAIGTTSSANFDATGLHSDRTYFFRVDASNEFGRSAQSSPVSASTPAVVTTVRAHFASAQGETLSLRGDMAPLNWDTGAAMSYLGDGVWQWQTDELSTARNINYKVLLNDTIWSEGAMYRIIGGQIVDIYPSFNQPPAIPSGLQAETLSSSEIAIHWDAVSDADSYTVYRSTVNWGGYEAIGTTADTEFQAVGLASSTTYFFRVSAANAYGASPRSVFVSATTEGEVPGIPSSVAAEALSASAIKVSWDTATGADGYEVYRSISSDGPFTIVASTSETTHIENGLASETVYYFRVNAVNEWGNSGFSSTASASTLGTAPSAPSGLSLTALSGTSVRAQWDAVSGAEYYTVYRSSAADGSYTAAGTASSPSMDISSLHSDRTYFFRVSASNQWGESSQSSHASVSTPAVTTTVRAHYSPSQGEGLYLRGDMAPLNWNTGVAMTYTGEGIWEWQTDALSTARNINYKVLLDDATWSEGAMYRVIGGQTVDIYPGFNTPPAIPQNVSADTQSSSTVLVSWDAVDDTEYYRVFMSTVSWGEYSEIGVTGDTSLQAEGLDSLTTYYFRVSAVNEYGTSARSTFVSATTFGVAPSVPANISASPLTASSIRVSWDAVSAVEEYRVYMAESSGGEYQTAGLTSNSSFDVSGLNPATTYYFKVRSLNEWGYSNQSSAVSAATYALPANIPTGLTAEAVSSSAINLVWDAVEYAETYTVYRSTSEDGTYTSIGTTESPSFQADNLSVSTRYYFKVRAVNAHGTTEQSVAVTARTFGTPPSVPQNVEAVVLSSTRIIVSWNSVAAADDYIVFIAADSAGPYEEAGIISSTVYEAENLSAKTTYYFRVAAVNEWGTSSAS

SEQ ID NO: 358 - DNA, 1422 bp, Unknown
  Obtained from an environmental sample
atgcaagtaatcagtactgttgtaaaacgccggctgagctggctgttgtttgtgctaacgccgctgctgagcagtaccgccagcgccgatgccattttacatgcctttgactggcattatgacgacgtggctgccaaagctaccgagatcaaagatctgggctataaagcggtgctggtcgcaccgccgttaaagtctaatgcggctaactgtgcctggtggcagcgctatcagccgcaggatatccgtgtaatagatcattgcaaaggcaacaagcaagcctttgtaaatatgatcaacgcgttaaacgatgctaacccggcgcgcaaggtcgacgtgtatgctgatatagtgttaaaccatatggctaatgagcgcagcggtgccactgattttcccggtagtgcagcagtaaatagctatggcagcaacagcagctactggaataaccagcagctgtttggcaatttaactcagggaattttcagcgccggcgactttaacccggctaactgcatcagcaattataacgatgtctggcaggtacaaaattaccgcttatgtggtggcgctggcgataccggcttgccggatttaaacccgaacagctgggtagtgcagcagcaacgcagttacttgacggcactgaaaaacctcggcgtaaagggctttcgtgtcgatgcggccaagcatatgaccatttggcatatcaacgaaattttcaccagcagcattaaaagcggtagctacctgtttggtgaaattattaccagcggtggcgctggcaacaacgagtacgacagttttttagcgccttacctgaactataccgatcataaagcctatgattttccgctgtttaacagtattcgtaatgccttcagttttggtggcagtttaagccagctggtaaacccggcggcttatggccaggcgctgcaaaacagccgggccgttacctttaccattacgcatgatattccgaccaatgatggctttcgctatctgatcatggacccgaccgatgagtatctggcctatgcctatgttatgggccgcgatggcggtaagccgctgatcttcagtgacagcaccggcacggacaataaccgctgggtcaatgcttataaagcggatcatattagcaagatgttgaattttcataaccgcatgcagggccagggcatggaaatgctggcgtggaatgactgcgctattctgtttcgccgtggccaggaaggcatagtaggcatcaataaatgcagtggcagccagagttttagtgttaatacccatggccgcttttactggtaccgcaattaccgcgatgtgttaaccggtggcaatctggtgtacatcaacggcggtaactatcacttcagcatacccgcgcgtggcgcgcggatgtggtatgccgactaa

SEQ ID NO: 359 - protein, 473 aa, Unknown
  Obtained from an environmental sample
  SIGNAL (1)...(29)
MQVISTVVKRRLSWLLFVLTPLLSSTASADAILHAFDWHYDDVAAKATEIKDLGYKAVLVAPPLKSNAANCAWWQRYQPQDIRVIDHCKGNKQAFVNMINALNDANPARKVDVYADIVLNHMANERSGATDFPGSAAVNSYGSNSSYWNNQQLFGNLTQGIFSAGDFNPANCISNYNDVWQVQNYRLCGGAGDTGLPDLNPNSWVVQQQRSYLTALKNLGVKGFRVDAAKHMTIWHINEIFTSSIKSGSYLFGEIITSGGAGNNEYDSFLAPYLNYTDHKAYDFPLFNSIRNAFSFGGSLSQLVNPAAYGQALQNSRAVTFTITHDIPTNDGFRYLIMDPTDEYLAYAYVMGRDGGKPLIFSDSTGTDNNRWVNAYKADHISKMLNFHNRMQGQGMEMLAWNDCAILFRRGQEGIVGINKCSGSQSFSVNTHGRFYWYRNYRDVLTGGNLVYINGGNYHFSIPARGARMWYAD

SEQ ID NO: 360 - DNA, 1938 bp, Unknown
  Obtained from an environmental sample
ttgagtgtaataaattgtgaagaagtgaaacgagatgagtttcatacagaaaagtactatgaaagttataacatctttggcgcacatgttgtgacggaagatgagattcaaggggtacgatttacagtctgggctcctcatgcgaaagcaatgagtgttgttggagattttaatgagtgggattatgagcaacataagatgctacaagtgacagaagaagggatttggtccttatttataccgcatattgaagaaggagaaatatataaatatgcgattgaaacgttggctggtgacgtcattttaaaggcagatccgtatgctatatatgcagaagtaagaccgaatacggcatctgtagtttttgatataaaaggatatgaatggaatgataaaaactggaatcgtaagaaaaagaaaaaaccgatttataaagaagcgatgacagtttatgaattacattttggttcttggaaaaagaaagaagatggaacactatattcttacagggaaatggcagaagaactcattccgtatgtggtggaacatcaatttacacatattgaaattatgccgcttgttgagcatccatatgatcgttcttggggatatcaaggaacgggatattatgcagcgacgagtagatttggtacaccgcatgatttaatgtattttgtcgacgaatgtcataaatatggaatcggtgtcattttagattgggtaccggggcatttttgtaaagatgctcacggtttatatttgtttgatggcacaccgacctatgaatataaagataaagatgtacaagaaaatctagtatggggaactgtcaattttgatttaggaaagagagaggtacgtaatttcttaatttcaaatgcgttattttggatgagatatttccatattgatggtttcagagtagatgcagttgcgaacatgttgtactggaataaagaaggacaagagcaaagtaatgagtacgctgtgtcatttttaagggagttaaatgaagcagtgtttgcagaggatgaagattttcttatgacggcagaggattcaacagcttggccacttgtaacagcaccaacgtatgaaggtgggcttggattcaattacaaatggaatatgggctggatgaatgacgtgctgaaatatatggagtgtgcgccagagtacagaaaatatattcatgagaaaatgacgttctctttactatatgcttactctgaaaacttcatattacccctttctcatgatgaagtcgttcatgggaaaaagtcgttattaaataaaatgccaggtgattactgggataagtttgctcagcttcgtttattatatggatatttctttactcacccaggaaagaaattacttttcatgggaggagaattcgggcagtttgatgagtggaaagaccttgaagatttagattggaatttacatgattttgaaatgcatcgttatatgcatgattactttaaagagctcatagcattgtataagcgctcaaaaccactttggcagcttgatcattcgcctgaaggttttcagtggattgatgctaataataacgagcaaagtattttctcgtttatccgccaaggggataaacaagaagatgcgttagttatcgtatgtaattttacgaaagctacatatgaaaactataaagtaggtgtaccagatttcgagtattataacgagattttaaacagtgatgcacagcaatatggcggttcgggacaagtgaataagaaacgtcttaagacgattctagaaccgtaccataatcaagcagcacatgtagagattacaattccaccatttggcgtatccatattacgaccagtgaagacgagaaaggggagcaaaaaacaagatggctcaaaaacaaaagtgcgtagcaatgttactagcagggggaaaaggtag

SEQ ID NO: 361 - protein, 645 aa, Unknown
  Obtained from an environmental sample
LSVINCEEVKRDEFHTEKYYESYNIFGAHVVTEDEIQGVRFTVWAPHAKAMSVVGDFNEWDYEQHKMLQVTEEGIWSLFIPHIEEGEIYKYAIETLAGDVILKADPYAIYAEVRPNTASVVFDIKGYEWNDKNWNRKKKKKPIYKEAMTVYELHFGSWKKKEDGTLYSYREMAEELIPYVVEHQFTHIEIMPLVEHPYDRSWGYQGTGYYAATSRFGTPHDLMYFVDECHKYGIGVILDWVPGHFCKDAHGLYLFDGTPTYEYKDKDVQENLVWGTVNFDLGKREVRNFLISNALFWMRYFHIDGFRVDAVANMLYWNKEGQEQSNEYAVSFLRELNEAVFAEDEDFLMTAEDSTAWPLVTAPTYEGGLGFNYKWNMGWMNDVLKYMECAPEYRKYIHEKMTFSLLYAYSENFILPLSHDEVVHGKKSLLNKMPGDYWDKFAQLRLLYGYFFTHPGKKLLFMGGEFGQFDEWKDLEDLDWNLHDFEMHRYMHDYFKELIALYKRSKPLWQLDHSPEGFQWIDANNNEQSIFSFIRQGDKQEDALVIVCNFTKATYENYKVGVPDFEYYNEILNSDAQQYGGSGQVNKKRLKTILEPYHNQAAHVEITIPPFGVSILRPVKTRKGSKKQDGSKTKVRSNVTSRGKR

SEQ ID NO: 362 - DNA, 2094 bp, Unknown
  Obtained from an environmental sample
atgaaaaaaattactttcttattggcattattgcttttggtaagcgcaacaatatttgccaacgaccccaaagacgacataatgctgcaatcatttggttgggacgaatacgaccagcccaaaataaaggctgctggtaacttctacaaatttgttgagtcgaaagctagcgagtggaaagctgctggtttcgatatgatatggatgccaccccctagtcgctccacaggtggtgtgggttatttgcccaccgagttacacaacttcaactcaacatggggcagcgaggccgacttacgtgctgctacggctgcactcaaagcacatggcatgtttcctattgccgatgtggttgccaatcatcgcaatggcaccacggcatggaccgactttacgaaccccgcatggagctgtgcaaccatcacatctaccgacgaggctaatgtaaattgggttgcatcgcgtggcccaaagccttgtggcgcacccgatacaggcgacgattttaatggcgggcgcgacctcgaccataccaatatcgaaacacgcaacggcataaaaacttttctcacaaaactaaaagaacaaggcttcgaaggctggcgttgggacatgaccaaaggttttagtgccagttatgtaggcgagtataacactgcaagccaaccctatttctcggtaggcgaatattgggacggaaactcgaacaccctcaaaaactgggtagatggcacaggcaaaaagtcggcaacattcgatttttcgcaatattattcgatggagaatgcattcaaaaataatgcatggagtgcattaggttcgggaagcagcatggccggtttggcgggtgtttttggctactccgactatgccgttacttttgtcgacaaccacgatacttttgtgcatggcagcgcgccactcggcgataatattatgaaagcctatgcctacatacttacgcaccccggcataccgagcgtatttattgcgcattattacggtggaacatatcgtaaagatggtgttactcgcacttacacaagccacaaagataaaatcgaccccataatggcagtgcgcaaagccaatcgtattgacgcttggagcacattacaagttgcaacaaattcgggcatgtatgccgcttatatcaaacgccgccacgacgatgccgctgcttcggtagccgtaaaaattggcccaggaagttggtcgcccgaaggtagtggctggattttagctgcatcgggaacagactacgccgtgtggtcgaaagcgcaaatagttgtagcacctaccatgctcattggtagtggaacttacgaattaggacaaacactcagcattacagctccgtcgggctatagcatacgctacaccaccgatggtagcgagccaacagcggcgtcgacactttacactgcgcccattacattgccacaaggcacaaccgttatcaaagctgcttcgtttgtaaatggtgttatgtcggccgtagtaaccaacacttacactgcacaagcaaaagcaaccagcataaaagtgcgtttcaaagctcccgcttcgtggacagcaagcaaagcctatgtgtgggaaaatcgtaatggcacaaacaccaaccttgcaggcgcatggccaggaacaacagctacaaaagacgctgatggattttatgtgtacaccataacaaatcacacacaatttagggtaaatattattttcaacaatgccagtggcacaaccgccagcgagcaaaccgaagacctttcggtaacggccgacatatgttggcaggcagtaggcagcaacaaatatggtgtagaaacagtgaactgcccaggcaccaatgtcgaaaataattacatacgtttattcaacatctatccaaatccgggcaaagaaacagtgcgtataaacaccaacgaaacattgcgcgcagtaaccatgtacgatagcatgggacgcatgcaccgcatgcaattaaatgccgacaatagtttggacataagcaatatggccgccggactgtatcagatgcaaattgaaacagaaagcggacgaaaagaaactcataaatttgtaaaattgtag

SEQ ID NO: 363 - protein, 697 aa, Unknown
  Obtained from an environmental sample
  SIGNAL (1)...(20)
MKKITFLLALLLLVSATIFANDPKDDIMLQSFGWDEYDQPKIKAAGNFYKFVESKASEWKAAGFDMIWMPPPSRSTGGVGYLPTELHNFNSTWGSEADLRAATAALKAHGMFPIADVVANHRNGTTAWTDFTNPAWSCATITSTDEANVNWVASRGPKPCGAPDTGDDFNGGRDLDHTNIETRNGIKTFLTKLKEQGFEGWRWDMTKGFSASYVGEYNTASQPYFSVGEYWDGNSNTLKNWVDGTGKKSATFDFSQYYSMENAFKNNAWSALGSGSSMAGLAGVFGYSDYAVTFVDNHDTFVHGSAPLGDNIMKAYAYILTHPGIPSVFIAHYYGGTYRKDGVTRTYTSHKDKIDPIMAVRKANRIDAWSTLQVATNSGMYAAYIKRRHDDAAASVAVKIGPGSWSPEGSGWILAASGTDYAVWSKAQIVVAPTMLIGSGTYELGQTLSITAPSGYSIRYTTDGSEPTAASTLYTAPITLPQGTTVIKAASFVNGVMSAVVTNTYTAQAKATSIKVRFKAPASWTASKAYVWENRNGTNTNLAGAWPGTTATKDADGFYVYTITNHTQFRVNIIFNNASGTTASEQTEDLSVTADICWQAVGSNKYGVETVNCPGTNVENNYIRLFNIYPNPGKETVRINTNETLRAVTMYDSMGRMHRMQLNADNSLDISNMAAGLYQMQIETESGRKETHKFVKL

SEQ ID NO: 364 - DNA, 1536 bp, Unknown
  Obtained from an environmental sample
atgaaaaattttaaaaagaaactaagtgcattgttattatcctttattcttattttctctagttttaatgctgctatagttcaagcagctaccaatggcacaatgtttcaatactttgaatggtacttaccaaatgacggaacgctatgggataaattaggtaatgatgctccaaacttaaagagtataggtgtaacagctgtttggataccaccagcatataagggaagttcacaggctgatgttggatatggtacctatgatttatatgacctaggtgaatttaatcaaaaaggtacagtgagaacaaagtatggaacaaagagccaattaatcagtgcagtagataaactacataataatggaatacaagtatatggagatgttgtattaaatcataagatgggtgctgatggaactgaaacagtttgggctgttgaagtaaatccaagcaatagaaatcaagaaacatcaggagattatcaaatttcagcatggacaaaatttgattttccaggaagaggaaacacatactcaagcttcaaatggagatggtatcattttgatggagttgattgggaccaaagcagaagcttaagtagaatatataaattaagaggagactataaaggatgggactgggaagttgatactgaaaatggaaattatgactatttaatgggtgcggatgtagacatgcaacaccctgaagttgtaaatgaattaaataactggggtaagtggtttacccaaacagtaaaattagatggatatagattggatgcagtaaagcatattaagtttgatttctttaatacatggcttgattatcaaagacaacaatcaggaaaggaactatttacagtaggtgaatactggtcagatgatttgggaaaacttcaaaattatataagtaaaacaggaagaagaatgtctctatttgatgttccactacaaagaaatttctataatgcttcaaatggtggtggatattatgatatgagaaatataaagagtggaacattaataagtgttgacccaactaaagcagttacatttgttgacaaccatgatacagaaccaggacaatcactacaaagatttgttcaagattggtttaagccacttgcatatacatttattttaacaagagaagaaggatatccatgtatattctatggtgattattatggaattccagcaaagggagtatcagcaaagaaggtagcaattgataagataatgcttgcaagaaagaattatgcttatggaaagcaaaatgactatttagaccactgggatataataggttggacaagagaaggagataatgaacatgctaattcaggtatggcagcacttataactgatggacctggtggttcaaaatggatgtatgtaggacaaaaattcataggaaagacattctacgatattacaggaaacagaacagatacagttgttataaattcatcaggttggggtgaatttaaagtaaatggtggttcatactcaatctgggttccaaagaattaa

SEQ ID NO: 365 - protein, 511 aa, Unknown
  Obtained from an environmental sample
  SIGNAL (1)...(29)
MKNFKKKLSALLLSFILIFSSFNAAIVQAATNGTMFQYFEWYLPNDGTLWDKLGNDAPNLKSIGVTAVWIPPAYKGSSQADVGYGTYDLYDLGEFNQKGTVRTKYGTKSQLISAVDKLHNNGIQVYGDVVLNHKMGADGTETVWAVEVNPSNRNQETSGDYQISAWTKFDFPGRGNTYSSFKWRWYHFDGVDWDQSRSLSRIYKLRGDYKGWDWEVDTENGNYDYLMGADVDMQHPEVVNELNNWGKWFTQTVKLDGYRLDAVKHIKFDFFNTWLDYQRQQSGKELFTVGEYWSDDLGKLQNYISKTGRRMSLFDVPLQRNFYNASNGGGYYDMRNIKSGTLISVDPTKAVTFVDNHDTEPGQSLQRFVQDWFKPLAYTFILTREEGYPCIFYGDYYGIPAKGVSAKKVAIDKIMLARKNYAYGKQNDYLDHWDIIGWTREGDNEHANSGMAALITDGPGGSKWMYVGQKFIGKTFYDITGNRTDTVVINSSGWGEFKVNGGSYSIWVPKN

SEQ ID NO: 366 - DNA, 1992 bp, Unknown
  Obtained from an environmental sample
atgaaaatctctagttttaactgcgcgacacttggcgcagggttattactttcctccgcacaggtaagcgcagcgccaacgacctttgtgcatttattcgattggaattggcaagatatcgctaccgagtgtgaaacctatttaggtccacaaggttacgctgccgtgcaggtttcgcctccaaatgaacatattgaagtgtctgagtggtgggcgcgatatcagcctgtaagctacgttctgcaaagccgcagtggcagccgcagtgagtttatcaatatggttgagcgctgtgatgcagtcggtgtagatatttacgtcgatgctgtcattaaccacatggccgctggaagcggtactggaactgcaggcaatacatttggcaataagtcttatcctatctactctccacaggactttcatgctacatgcgctattaatgactacggcgatcgctggcaagtacagaactgcgagttagtcgggttggccgacttaaataccgccgataattatgtacagacgacgctggccggatatttaaatgatcttgtgaacattggtgttgccggtttccgtctggacgcgtcaaaacacatggctgcaaccgatattgaaggtatcttacagagagtaaatggcgatccgcttatttttcaggaagtgattgatcaaggcggcgaagcggtaagtgcttcagagtattttgggaacggcctggtaaccgaatttaagtattctgtagaaataggaaatacatttcgcaacggctcgctggcatggctgagtaacttcggcgaagcgtggggattcatgcctagctatcaggcagtcgtgtttgttgataatcacgacaatcagcgtggtcatggtggaggtggaaatgtcatcacctttgaggatggcagactgtatgatttagccaatgtatttatgctggcgtggccgtacggctaccctaaagtaatgtccagctttgactttcatggcgatacagatgcgggacctcctggcgttccggtccataacgacggcaacctcgaatgctttggcagtaactggaagtgtgaacaccgctggagctacattgcaggcggtgtaaactttagaaatagcaccgcggacaatttcactgtcaccgactggtggagcaacggtgccaaccaaatcgccttcggccggtctgacagtggctttgttgtcattaataaagaatcttatgaccttaacaccactctcgaaacgtcaatggcaccgggagagtattgtgatgttctcacaggcgagctcaatgcatcaggcgatggctgtaccggcaataagctttcggtagatagcaatgggcgcctttctgtctccgtcccatcctgggaagcgattgccattcaccataatgccaaagtggcagccacatcaaattcggcagactggcaacgaacgatgatattcatcgaagccgaaactgccagtggtcaagatatgtttgttcggggcgacattgaccatcaagccgcagcgaaccaactcggcatcacctgtacagatacaaattacgcttgtgcagtgccgattgtgcataataacttgcgcaatacgactacggcttcctggaaggcaaatgacaactatcttgactggtatggtgttgaagactcccagagtactgacgcagaaggcagtgcgctggactggacaaccaactcctggcccgcagaatggggaaccttaaaaaccgtgattgacgatggtttcggtgaaacgccctataatacctggggctcgcatttctggatgctcgacgtacaaatggattgcagtaagacagtgaatgggtggttcgaacttaaagcctatgtcaaaaacgggcagggctgggaaggcgatatcagtcagagcggtacaccctacccatcaaccaaccacatggcgcaatgcggtaaaaagaatatgttccggtttggacaaagcacggtgcaaatcagcgatctgtaa

SEQ ID NO: 367 - protein, 663 aa, Unknown
  Obtained from an environmental sample
  SIGNAL (1)...(24)
MKISSFNCATLGAGLLLSSAQVSAAPTTFVHLFDWNWQDIATECETYLGPQGYAAVQVSPPNEHIEVSEWWARYQPVSYVLQSRSGSRSEFINMVERCDAVGVDIYVDAVINHMAAGSGTGTAGNTFGNKSYPIYSPQDFHATCAINDYGDRWQVQNCELVGLADLNTADNYVQTTLAGYLNDLVNIGVAGFRLDASKHMAATDIEGILQRVNGDPLIFQEVIDQGGEAVSASEYFGNGLVTEFKYSVEIGNTFRNGSLAWLSNFGEAWGFMPSYQAVVFVDNHDNQRGHGGGGNVITFEDGRLYDLANVFMLAWPYGYPKVMSSFDFHGDTDAGPPGVPVHNDGNLECFGSNWKCEHRWSYIAGGVNFRNSTADNFTVTDWWSNGANQIAFGRSDSGFVVINKESYDLNTTLETSMAPGEYCDVLTGELNASGDGCTGNKLSVDSNGRLSVSVPSWEAIAIHHNAKVAATSNSADWQRTMIFIEAETASGQDMFVRGDIDHQAAANQLGITCTDTNYACAVPIVHNNLRNTTTASWKANDNYLDWYGVEDSQSTDAEGSALDWTTNSWPAEWGTLKTVIDDGFGETPYNTWGSHFWMLDVQMDCSKTVNGWFELKAYVKNGQGWEGDISQSGTPYPSTNHMAQCGKKNMFRFGQSTVQISDL

SEQ ID NO: 368 - DNA, 1257 bp, Unknown
  Obtained from an environmental sample
atgtttatttacaatcttttccctaggctttatgggccatttagcaagtggatagacgacttagatagaataaaggagttgggagtagactggatatatataaaccccgtatcttatcccgggttttccggcagcctatactcaataaaagatcattacaaattcaaccctctgttcctagactctaattcaaaaaaatcaccagaggaacaattcagagatttcattaaagcgtgtaaatcaagaggaataaaagtaatcgttgatttggtagtcaatcacacagctatagattccgtacttgtagacaaacatcctaactggtacaaaagagacgaaaacgggcaaataaagagaccaggcgcatgggataatagcgtatgggttgaatggggagatttagcagaactagacaacgagaacagtcctgataaaagagcattatggaactattggaaagacctagtagagtggcatatagacttgggagttgatgggtttagatgcgactatgcttataatgtccctgtagaattatgggacttcctaataaagaacgcaaaatccaagaaagaagatgttatattcttagcagagatactcggaggtccctttgatagaaacctagaagttgcaaaagctggctttgattatgtatttagcagtgctaaatggtggaatttctcagacgcttggttcatagaacaaacaagagagttctcaaaatatgttaaagcaatagcatttcctgaatctcatgacacaccaaggttgaattcggagtacgaagaagatttagcaaaaataaagcaaagattcatatttacagcattcataaatgaaggattaatgatacctgtaggatttgagtttggcttcattaacaagctagatgtggtaaaaacaaccccagactggtgggaaataccatcttatgacatttctaagttcataaaacacatagttgaaatcaaaaaaaagcatcccatattgtcatatgacgctacatcagtagatatgctagaaaacacccctgacatctcaatgtttgtcaagaggaacaagctaacagaccagattgcccttttcgtagttaacaaaaacacaacctcaaaagtaaagagaataatagatttccctagtgtattcggttattatgatgctatagatgtaatagataacgttgtaatgcctaagtacgctgaagtaacagtaccgagagcaggtataaaagttttcgtaaacagaatacactaa

SEQ ID NO: 369 - protein, 418 aa, Unknown
  Obtained from an environmental sample
MFIYNLFPRLYGPFSKWIDDLDRIKELGVDWIYINPVSYPGFSGSLYSIKDHYKFNPLFLDSNSKKSPEEQFRDFIKACKSRGIKVIVDLVVNHTAIDSVLVDKHPNWYKRDENGQIKRPGAWDNSVWVEWGDLAELDNENSPDKRALWNYWKDLVEWHIDLGVDGFRCDYAYNVPVELWDFLIKNAKSKKEDVIFLAEILGGPFDRNLEVAKAGFDYVFSSAKWWNFSDAWFIEQTREFSKYVKAIAFPESHDTPRLNSEYEEDLAKIKQRFIFTAFINEGLMIPVGFEFGFINKLDVVKTTPDWWEIPSYDISKFIKHIVEIKKKHPILSYDATSVDMLENTPDISMFVKRNKLTDQIALFVVNKNTTSKVKRIIDFPSVFGYYDAIDVIDNVVMPKYAEVTVPRAGIKVFVNRIH

SEQ ID NO: 370 - DNA, 1614 bp, Unknown
  Obtained from an environmental sample
atgaaacgctacttaacactcaccctactgcttaccctgttgatacttgcgccgctggctttggcacaagagtccgatgagggcgcagcatgggctaacgagactgttttttatgagatttttgtgcgtagcttttacgatagcgacggtgacggtaaaggggatattcgcggcgttatcgaaaaactcgattacctcaacgacggcgacccgaataccacaaccgacttaggcattaccggcatttggttgatgcccgtcatggagtcgcccagttatcacggctacgacgcgaccgattactacatgctcgataaagactacggcacaaacgacgacttcaagctgttcatggaagaagcgcacaaacgcggaatccgtgtcatcgttgacttgatgctcaatcacacctcggtgcagcatgagtggttcatcgaatcgggtgacccgcaaagcgaaaaagccgattggtacatctgggaagatgagaacccgaattatcgcggcccggataatcagcaggtgtggcacggcctacgcgggcgctattactacggcgtgttctggtcagggatgccggacttgaacttcaccaatcccgatgtcaccgcgcaaatgtacgatgtcacgcgcttttggctagaagagatgaacgtggacggcttccgccttgacgcgattaaacacatcatcgaggatggcaccattcaagagaacacccccgccacgcgccaatggctggccgattaccgcgcgttcgtcaagtccatcaagcctgacgcgctgttggtcggtgaggtctggtcgccgacgttcgctatcgcgccgtatgtgggcacagcggttgacatcgcgtttgagttcgacttggccgaggcgctgatacgcggcgcgagctttggcacgcccaacctcgtcacgcgacagctagagacggtctttgagagttacccgcccaacgctttcgccacattcttgactaaccacgatcagaaccgcttcatgacccaaattcgcggggacgcggcagcggccaaaaacggcgcatcgttgctactcacgttgcccggggtaccgttcatttactacggtgaagaaatcggcatgaccggcatgaaacctgatgaggacatccgcaaaccgatgcagtgggacgatacccccaagaccgctggtttcaccagtggtgagcgcgtgtggcgtgctgtgaataacgatgcattcgagggcgtcaatgtggccgcacaaaccgaaaaccccgactcacttctaagccactaccgcgcgctggttcaagcacgggtgagcagccccgcgttacaaagcggcgacatgattttggttgaatcgtctaaccgtaagctgtttactttcttgcgccaaagcgaggcccaaacggtgctggtgatgattaaccttgacgaccgtcccgtgaccgagtacacgctcacgctggaaagtggcacactcgcggaaggcgtgacagcatcggcgctcctcgcatcaggtgaggtaaacgcgccacaggtcaacgggcaaggcggctttgcggattacaccccgcttgcagaactcgcgcccaattcggtcacgctgattcagcttggggaataa

SEQ ID NO: 371 - protein, 537 aa, Unknown
  Obtained from an environmental sample
  SIGNAL (1)...(22)
MKRYLTLTLLLTLLILAPLALAQESDEGAAWANETVFYEIFVRSFYDSDGDGKGDIRGVIEKLDYLNDGDPNTTTDLGITGIWLMPVMESPSYHGYDATDYYMLDKDYGTNDDFKLFMEEAHKRGIRVIVDLMLNHTSVQHEWFIESGDPQSEKADWYIWEDENPNYRGPDNQQVWHGLRGRYYYGVFWSGMPDLNFTNPDVTAQMYDVTRFWLEEMNVDGFRLDAIKHIIEDGTIQENTPATRQWLADYRAFVKSIKPDALLVGEVWSPTFAIAPYVGTAVDIAFEFDLAEALIRGASFGTPNLVTRQLETVFESYPPNAFATFLTNHDQNRFMTQIRGDAAAAKNGASLLLTLPGVPFIYYGEEIGMTGMKPDEDIRKPMQWDDTPKTAGFTSGERVWRAVNNDAFEGVNVAAQTENPDSLLSHYRALVQARVSSPALQSGDMILVESSNRKLFTFLRQSEAQTVLVMINLDDRPVTEYTLTLESGTLAEGVTASALLASGEVNAPQVNGQGGFADYTPLAELAPNSVTLIQLGE

SEQ ID NO: 372 - DNA, 1437 bp, Unknown
  Obtained from an environmental sample
atgttcaaaatagtgccgctcctttctctcgtcacggctttcgtcatcggcgcatacccgctgcgcgcgcagtccgctatagaggacctggtaaaggcctctccggtccgggaccaggccgtaccggccccctccgagcccaaatccgcccacacgcccagcgccctggcgcgccaggactggaaaacggccgtaaccctctattcggccaagaacttcaatcctccgcccgcgcggcggctgaacctcgaggcctcgccggtggtcatgctgcagggcttccactggtacgccgacaattactggctcaacctgccccgcggctggtggggcaggctggccgagaaagccccggaggtcggcgccgccggcttcgacctggtctggttccccccggtatcccgcggcagctattaccccaccgagtggtacgacctcgattcccagtggggcaagaaagacgtcctgatagaggccgtgcgggcgatgaaggcccacggggtcagcccggtggccgacatcatactcaaccaccgcaacggcaccctcgactgggcggatttcaccagccccgactggccgaccacggcgatagtcagggacgacgagtggcagggcatgaaaggccccaattacgacgagggacagggagagggcggctgccgcgacctggatcacaacaacgccctggtgcgcgaggacgccaaggtcttcctgcgctggctgcgctacaccgtcggtttcgaaggctggcgctacgacatggtcaagggcttcctgccccacaggatcaaggactacaaccgcgcttcggcgccggccttctcggtaggggaatactacgacaccaaccgccagctgctggtcaactgggtggacggcacggccgacggcgacaagtcggaagcctccacggtcttcgatttcaccacccgctacaacctggtggccgccgtagagagcgagcgttacgacctgctcagcgaccacggccgcccctccggctccatcggctggtggccggccaagtcggtcaccttcgtggagaaccacgacacctcgccccgcgaccccaagttcctgcagaacgccccgcgcgagtaccgcgtccagcgccagatgggctacgcctacatccttacccatcccggcacgcccagcgtcttctggccccatttcttcgactggggttccgaatacagggccaagctgcaggagctcgtcaatatccgcaagtcggccggcataaccgccgtcagcccggtgcagatactcgcggcctacaacgagctctacgccgcgatgataaccggcagcgataagtacgtcgtattgaagctcggcaagaactggggctggcagcccggccacgactggaagctggaagccagcggcgagcgctgggccgtctggacccagcccgtcaccaggccctga

SEQ ID NO: 373 - protein, 478 aa, Unknown
  Obtained from an environmental sample
  SIGNAL (1)...(25)
MFKIVPLLSLVTAFVIGAYPLRAQSAIEDLVKASPVRDQAVPAPSEPKSAHTPSALARQDWKTAVTLYSAKNFNPPPARRLNLEASPVVMLQGFHWYADNYWLNLPRGWWGRLAEKAPEVGAAGFDLVWFPPVSRGSYYPTEWYDLDSQWGKKDVLIEAVRAMKAHGVSPVADIILNHRNGTLDWADFTSPDWPTTAIVRDDEWQGMKGPNYDEGQGEGGCRDLDHNNALVREDAKVFLRWLRYTVGFEGWRYDMVKGFLPHRIKDYNRASAPAFSVGEYYDTNRQLLVNWVDGTADGDKSEASTVFDFTTRYNLVAAVESERYDLLSDHGRPSGSIGWWPAKSVTFVENHDTSPRDPKFLQNAPREYRVQRQMGYAYILTHPGTPSVFWPHFFDWGSEYRAKLQELVNIRKSAGITAVSPVQILAAYNELYAAMITGSDKYVVLKLGKNWGWQPGHDWKLEASGERWAVWTQPVTRP

SEQ ID NO: 374 - DNA, 1398 bp, Unknown
  Obtained from an environmental sample
atgaaacacacagcgggaatatgggcgatcgcaggcatgctgatcgcccccttggcgcacgccgacgtcatactgcacgccttcaactggaagtacagtgaagtgaccgccaaagccgatcttatcaagtcagccggttacaaacaggtactcatctcaccacctctcaagtcatcaggcaacgagtggtgggctcgttaccagccgcaggatctgcgtcttgtcgactcccctcttggcaacaagcaggatctcgagcagctgatcgccgccatgaaggcgcgaggtatcgccgtctatgccgatgtggtgctcaaccacatggccaacgaaagctggaaacgcagcgatctcaactatcccggcaacgagctgctgcaaagctacgccagcaacccggcctatttcgagcgccagaaactgtttggcgatctggggcaaaacgtcctctccggtcaggattttcatcccgaagggtgcatcagcgactggagcgatccgggtcatgtccagtattggcgactctgtggtggtgccggtgacaaggggctgccggatctggatcccaacaactgggtggtcagccagcaacaagcctatctcaaggcgctcaaggggatggggatcaagggttttcgggtcgatgcggtcaaacacatgagcgattaccagatcaatgctgtgttcacccccgagatcaaacaggggatgcacgtgtttggcgaggtgatcaccacaggaggggcaggcagcaccgattacgagcgcttcctcaaaccctacctcgacagcagcggccagggagcctatgactttccgctgtttgcctccctgcgtggtgcgttaagttacggtggcagcatgaacctgctggcggatccgggcgcctatggtcaggcgctaccgggcaatcgcgccgtcacctttgccgtgacccacgacatccccaccaacgacggcttccgctatcagatcctgagccagactgacgagaagctggcctatgcctacctgctcggccgcgatggtggctcaccactggtctattcggatcacggcgagacccaggccaaggatggactgcgctggcaggattactaccagcgcgccgatctcaaggggatgatccgtttccacaatgcggtgcagggccagcccatgcagctggtcggcagtggcgactgcttcgtgctgttccaacggggcaaacaggggctggtcggcatcaacaagtgcgactatgagcaggagtactggctcgataccgccaggttcgagatgaactggtatcgcaactatcgggacgtgctcgaccaaggggccgtagtcaacgtgcagagccagtgggtacgggtcgccattcctgcccgcagcgccagaatgtggctgcaggagtga

SEQ ID NO: 375 - protein, 465 aa, Unknown
  Obtained from an environmental sample
  SIGNAL (1)...(21)
MKHTAGIWAIAGMLIAPLAHADVILHAFNWKYSEVTAKADLIKSAGYKQVLISPPLKSSGNEWWARYQPQDLRLVDSPLGNKQDLEQLIAAMKARGIAVYADVVLNHMANESWKRSDLNYPGNELLQSYASNPAYFERQKLFGDLGQNVLSGQDFHPEGCISDWSDPGHVQYWRLCGGAGDKGLPDLDPNNWVVSQQQAYLKALKGMGIKGFRVDAVKHMSDYQINAVFTPEIKQGMHVFGEVITTGGAGSTDYERFLKPYLDSSGQGAYDFPLFASLRGALSYGGSMNLLADPGAYGQALPGNRAVTFAVTHDIPTNDGFRYQILSQTDEKLAYAYLLGRDGGSPLVYSDHGETQAKDGLRWQDYYQRADLKGMIRFHNAVQGQPMQLVGSGDCFVLFQRGKQGLVGINKCDYEQEYWLDTARFEMNWYRNYRDVLDQGAVVNVQSQWVRVAIPARSARMWLQE

SEQ ID NO: 376 - DNA, 1551 bp, Unknown
  Obtained from an environmental sample
atgtcacaattcctaaggttcgcagtcaggcgcatatgtactcagtggtggtgccgtaccactgggattattcttctggtggttttcgcgggcgtgtcggcggcgttgggccaggccggtttcgacgatgaccgtgtcatgctgcagggattttattgggaatcctatcggcatggacacctggagaagttccccaattacggcgataaacactggtacgtgattgtacaaaacctcgcaccggaaatccgagccggccgcttcaatctgatctggctgccgccgccctcgtacgcgggcggctttagcgccggctataatccaaaggagtactttcgccttgataacagctacggcacgttcgatgagcaccgcgccgcgcttgaagcgctccttcggaacggaatcgagccagtggctgatctagtcatcaatcaccgcgacggtaaccaggcgtgggcggatttcaaaaatcccgattggggaacttgggcgatctgccgaacggacgaggcattcacaaatgtgaactccggcatcaccaatacgccgaacgatcaacgcggtaactgtgaggaagaagccgattatcggcccgagggcacgtataattattcggattttcgcgacattgcgcatgctgatccgcgggtgcggcgcgacattgaacgatatctgctccagttaaaatctttgggttaccgggggtggcgttacgatatggtgcacggctataacgcgagatgggttgcgctctataatcgactcacgcaacccactttctcggtaggagagtacgattgggacaagcacgcgcagcagcgtggctggatatggggaaccgcaacgaacccgactccaacgggtgcagatcacctcagaacttcgagcagcgtctttgatttcacgagccagttcagtctgaaatcaatcaacagcggaaactacacggcactgtatggcttcggaaacggcatcggtctggtgggcgatacaacagatgggctgccgtggaagaatcgcgccgtgacgtttctcgaaaaccacgataccgggtaccgcaccaacgaggacggcacgccgcagcagggccaccaattcgattcgtttgcgaacaactggcaggtcgagcaggggtatgcgcagattttgacacatcccggtgtgcccactgtctactggaagcattactttgactggggatcggacctgcagaataagatcagagcactgatcaatgctcggaaggtagcgggggttaacgcgggcagtaaggtagacccacaggacaatgccaaatactcgggcgtatacgcggctagaatcagcggacgtaatggcgagttgtacgtgcgcataggagggagcgaccagcaatggcagcctagtgcttcgggatatgccgattaccgcgagtacgcgcaaggagccggctggaaagtctgggttaaattacctggaaatcccccggtgcagcaggtgcctcttcccagcgcgttgcctgttccgcagtaccggcctccggaccaaatcgagcccccacccgaatga

SEQ ID NO: 377 - protein, 516 aa, Unknown
  Obtained from an environmental sample
  SIGNAL (1)...(37)
MSQFLRFAVRRICTQWWCRTTGIILLVVFAGVSAALGQAGFDDDRVMLQGFYWESYRHGHLEKFPNYGDKHWYVIVQNLAPEIRAGRFNLIWLPPPSYAGGFSAGYNPKEYFRLDNSYGTFDEHRAALEALLRNGIEPVADLVINHRDGNQAWADFKNPDWGTWAICRTDEAFTNVNSGITNTPNDQRGNCEEEADYRPEGTYNYSDFRDIAHADPRVRRDIERYLLQLKSLGYRGWRYDMVHGYNARWVALYNRLTQPTFSVGEYDWDKHAQQRGWIWGTATNPTPTGADHLRTSSSVFDFTSQFSLKSINSGNYTALYGFGNGIGLVGDTTDGLPWKNRAVTFLENHDTGYRTNEDGTPQQGHQFDSFANNWQVEQGYAQILTHPGVPTVYWKHYFDWGSDLQNKIRALINARKVAGVNAGSKVDPQDNAKYSGVYAARISGRNGELYVRIGGSDQQWQPSASGYADYREYAQGAGWKVWVKLPGNPPVQQVPLPSALPVPQYRPPDQIEPPPE

SEQ ID NO: 378 - DNA, 1269 bp, Unknown
  Obtained from an environmental sample
atgttgaagcagttcacgaagcgcctgatcaccctgacgagcctgctggcgctcgtcctcgtcgcaccgttggccagcgcgggcccgctggatggcaacagcagcgacgtcatgttgcagggcttccattggtactcgtaccagtcgtttccgtggtggggcgtcatcaagaacaacgcggcgagcatcaaggccgacggcttcaccatggtgtggctgccgccgcccagcgacgcggcctccaacgagggctacctgccgcgccggctcgagctgctggacagcaagtatggcacccggacggacctggtcaacgccctgtccgcgctgaatgccaatggtgtgaagcccattgcggacatcgtcatcaaccaccgcgtgggcaccacgggctgggcggacttcacgctgcctccgtggggctcgaacgcggtgtgccgcggcgacgagtggagcggggccacgggcaacgcggatacgggcgatggcttcaacgccgggcgcgacatcgatcacacgcagaccttcgtgcaggacggcatcgtcacctggatgaacaactcgctgaagagcgtcgggttcgcgggttggcggtatgactacgtgaagggctacagcggctcctacgtcggctcgtacaacacccgcacgacgccgtacttctccgtgggcgagctgtggacggacctggacctgaacaaccccaacccccaccgccagctgatcatgaattggatcgacgcgacgggtggccggtccgcggcgttcgacttcacgaccaagggcctgctgcagcaggcggtgcagtacaacgagttctggcggctgaaggatgcggcgggcgcgccagcgggtgccattggttggtgggcagcgaagtccgtgaccttcatcgacaatcacgacacgggcccgagctatccgagcggcggccagaaccactggccgttccctggtgacaagatcctccaggggtacgcctacatcctgactcactctggcatcccctgcgtgtactgggtgcactacaaggactggggccaggcgaacacggacgccatcaagaagctgatcagcatccgcaagtccaagggcatcaccagcacctcctcggtgagcatccaggccgcggacagctcgaagtacgccgccatcatcaccggcaacaacggcaaggtggccgtgaagatcggcttcggcgcctggtctccgccgggcacctggacgctggccacctccggcaacaactacgccgtctggacgcagtaa

SEQ ID NO: 379 - protein, 422 aa, Unknown
  Obtained from an environmental sample
  SIGNAL (1)...(27)
MLKQFTKRLITLTSLLALVLVAPLASAGPLDGNSSDVMLQGFHWYSYQSFPWWGVIKNNAASIKADGFTMVWLPPPSDAASNEGYLPRRLELLDSKYGTRTDLVNALSALNANGVKPIADIVINHRVGTTGWADFTLPPWGSNAVCRGDEWSGATGNADTGDGFNAGRDIDHTQTFVQDGIVTWMNNSLKSVGFAGWRYDYVKGYSGSYVGSYNTRTTPYFSVGELWTDLDLNNPNPHRQLIMNWIDATGGRSAAFDFTTKGLLQQAVQYNEFWRLKDAAGAPAGAIGWWAAKSVTFIDNHDTGPSYPSGGQNHWPFPGDKILQGYAYILTHSGIPCVYWVHYKDWGQANTDAIKKLISIRKSKGITSTSSVSIQAADSSKYAAIITGNNGKVAVKIGFGAWSPPGTWTLATSGNNYAVWTQ

SEQ ID NO: 380 - DNA, 1644 bp, Unknown
  Obtained from an environmental sample
atgaagccgcgttgggcagcgtggcttgtcctcgtatgcttgctggcgggctgcttcgggggagaaagcgcgcctgccgatcatgcggcccggtcttccgctccggacggaacgccggcgccggtcccgtccgctgcagccgcagggtggaaagcggatgaacaaccgtcgacggtgttttacgagattttcgtgcgctcgttctacgactccgacggagacggcatcggggatttgaacggcgtgacggagaagctcgactatttgaaggagttgggagtcggcggcatctggctgatgccgatcaacgcgtcgccgagctaccatggctacgatgtgacggactactatgcgatcaaccccgactacggcacgttggaagacttgaaaaggctgctggccgaagcgcatgcgcggggcatcaaagtcattatggatcttgtcgtcaaccatacgagccgcgagcatccctggttcaaggaggcgcttgccgatccggacagcccttaccgcaactggtatacgatcaaaccgtcggacgaggcggcgccttcggacaacgcggcggggaccggcagtccctggcatgatgcgggcagctacaaatacctcgggattttctgggaaggcatgcccgatttgaatttcgacgagccgaaggttcgcgaagagatgatcaaggtcggccggtactggctggagcagggggttgacggcttccggctggatgcggccaagcatatttacggggatttcgcctccaccgtccactcggaggaaatcgcgggcaaaaacaaagcgtggtggcaggaattccgcagcgggttgaacgaggccaatccgaacgcttacctcgtgggcgaaatctgggattcggcgacgacgatcgcgcctctgctcgacaaggcgctcgattccggattcaacttcgatttggcgggacggattctcgacgccgcgaagggggaacgcgacccggacgtcgccttcagcctgaagcgggtatacggcgcttacggccaagcgtccggcggttcgttcacggacgcgacgtttctctccaatcacgaccagaaccgcgccatgagcgtgctcggcgggaacgtaaatcacgcgaagatggccgcggcggtgctgctgacgctgccgggcaatcctttcctttattacggggaggaaatcggcatgctcggcatgaagcccgatgaagcgatccgcgagcccatgccttggtacgccggcccatcgggcgggccggggcagacgtcttgggaaccgctgcggtacaacaagcccggcgccacatcggtcgagcagcaggagcgggacgagcggtcgctgctccatcattaccgcacgctgatcaagtggcggaatgaaatgcccgagctgcgggacggggatatcgacgagtacgataccggcaacgcgaagctcggcgcttacgtgcggatgacgaaggacgcccgcgtcctcgtcgtgcacaatatgagcggcgagaagcagtcggcgaagctgacggcgtcggagcggtacggagcgttccgggaaatcgtgcgccagaccggcagcggcggcgaaggcgcttcgcttgacggggaaacgctctccatcgctccgtacagcacggtcatcatccgctag

SEQ ID NO: 381 - protein, 547 aa, Unknown
  Obtained from an environmental sample
  SIGNAL (1)...(29)
MKPRWAAWLVLVCLLAGCFGGESAPADHAARSSAPDGTPAPVPSAAAAGWKADEQPSTVFYEIFVRSFYDSDGDGIGDLNGVTEKLDYLKELGVGGIWLMPINASPSYHGYDVTDYYAINPDYGTLEDLKRLLAEAHARGIKVIMDLVVNHTSREHPWFKEALADPDSPYRNWYTIKPSDEAAPSDNAAGTGSPWHDAGSYKYLGIFWEGMPDLNFDEPKVREEMIKVGRYWLEQGVDGFRLDAAKHIYGDFASTVHSEEIAGKNKAWWQEFRSGLNEANPNAYLVGEIWDSATTIAPLLDKALDSGFNFDLAGRILDAAKGERDPDVAFSLKRVYGAYGQASGGSFTDATFLSNHDQNRAMSVLGGNVNHAKMAAAVLLTLPGNPFLYYGEEIGMLGMKPDEAIREPMPWYAGPSGGPGQTSWEPLRYNKPGATSVEQQERDERSLLHHYRTLIKWRNEMPELRDGDIDEYDTGNAKLGAYVRMTKDARVLVVHNMSGEKQSAKLTASERYGAFREIVRQTGSGGEGASLDGETLSIAPYSTVIIR

SEQ ID NO: 382 - DNA, 4176 bp, Unknown
  Obtained from an environmental sample
gtgctgctgcgcacgcccaccgcgcgcagaggactggccgtcgccacggcggccggtgtcctcgcgacgctgatccacgcggcggcggccccggccgcccaggcggcccccccgccgccgaccgacgccgaactggccgccgagccgacccggcacgccctcaccaccgagcagttctacttcgtgctcccggaccgcttcgccaacggcgacccgtccaacgacaccgccggcatccccggcggcccgctcgaccacgggtacgaccccgacgacgagggcttctaccagggcggcgacctgcgcggcctgatcgagaacctggactacatcgagggcctgggcaccaccgccctctggatggcgcccgtcttcgagaacaagccggtccagggcgagggggaccacgcctcggccggctaccacggctactggatcaccgacttcacccgggtggacccgcacttcggcaccaacgaggaactcgccgaactggtcggggccgcgcacgagcgggacatcaaggtcttcttcgacgtcatcaccaaccacaccgccgacgtcatccactacgacgagggcgcctacgactacctctccaagggcgccttcccgtacctcgacaccgagggccgccccttcgacgacctcgaccacgccggtgccgaggacggggggttccccgaactcgacaccgcctccttcccgtacacgccggtgacctccgacgccgaggccgacctcaaggtccccgactggctcaacgacccgacgctctaccacaaccgcggcgactcctccttcgccggcgagagttccctgtacggcgacttccacggcctggacgacctgttcaccgcccggcccgaggtcgtcgagggcatggtggagatctaccgcacctgggtcgaggacttcggcatcgacggtttccgcatcgacaccgtcaagcacgtcaacatggagttctggacccgctggtccgccgccatgaaggagcacgccgcgtccctcggccacgaggacttcttcatgttcggcgaggtgtactcctccgatgtcgccgagaaggcccggtacgtcaccgagggcggcctgaacgccaccctggacttcgccttccaggaggccgcccgctccttcgcctcgcagggcggctccgcgaagcgcctgtccgccctcttcggcgaggaccaccgctacaccaccgccgacaccaacgcccagcagtcggtcaccttcctgggcaaccacgacatgggccggatcggtcacttcctgcgcgccgacaacccggacgccgacgaggccgagctgctcgagcgttcccgcctcgcccacgagctgatgttcctgtcccggggcaacccggtgatctactacggcgacgagcagggcttcaccggttccggtggcgacaaggccgcccgtgccaccctcttcggctccacgacgccgctctacctggaggacccgcaactgggcaccgaccgcacccacgcggaggacgcccacgacaccgaccatcccctgtaccgggcgatcgccgccctctccgccctcacccgcgagcacccggcgctgcgcgacggcgcgcagaccgagcggtacgcggaggacggcgccggcgtccgggcccacacccgcaccgacgccgacgaacgggtggagtacctggtcgccgccaacaacgcggaggacggacgcaccgtcgccgtgcccaccgacacccccggcgccgtcttcgaggtcctgtacggcggggtcggcgacggttccgcgaccccggtgaccgccgacgccgacggcgtcgtcgagctgaccgtgcccgccctgtccaccgcggtactgcgcgccgaccgacccctgcccgacccgcaggccgcccccgccgtggagctcaccgcccccgacgccggcgcacacggtgtcgtggagctctccgccgccgtcaccggcggcgcgctcaaccgcgtcgccttcgccgcgcaggtcggcgacggcgactgggaggtgctcggggtctccgacgccccgccgcaccgcgtcacccacaccgtcccggccggcacctccgccggtaccccgctgcgctaccgcgccgtcgccgtggattcctccggcgccaccgccgcgaccggcgcggagaccaccgccggcgccccgccgccggaacgggcgccgcgcgccgtgagccgggagtgggccgtcgtccactaccaccgccccgacgggaactacgacgactggtcgctgtgggcgtggggcgacctccacgagagcgagagcttcgaggactggccccacggccggcccttcgtcggccgcgacgccttcggcgccttcgcccgggtccgcctggcccccgacgcctccgaactcggctacctgatcgtggacggcgacggcaccaaggacggtgacctcgaccgggtcatcgacctctccgagaccggcgaggtctggatcgagcagggcgagccggaggcgctcaccgaggcgcccgaaggcgtgtatccgcccgccgacgagtcgcgcgccgtcctgcggtaccaccgacccgacggcgactacgatggatggggcgtgcacgtgtggaccggcgcggccgagcccaccgactggagccgacccgttccggcctccgaggtggactccttcggcgccgtctacgagatcccgctcgccgagggcgcgacctctctgagctacatcatccaccggggcgacgagaaggacctgcccgccgaccaatccctggacctgcgggccgtcggttacgaggtgtggatcatctccggagaggagacgtacctgttgcccagcggcggagccgcccccgacctgaaccccgaccgcgcccgggcccactggatcgacgccgagaccgtcgtgtggcccggcgttgccccgcccggtggcagccggcagctgatccaccaccccgagggcgccatcgccctcgaggacggcgcgctcaccgacgagggccactggatcaccactccgccggcgggcgagcgcgacccgcgaccgggtttgaccggccttgagccatcggacatgggtcgctggtttgccgagcgcggccagcccggctaccgcgcccgccagctggccgatcacgtctggcaggcgtgcgccatccgggcggacgagctgcggaccctgccggccgcgttgcgcacagacatagaagactcgttccgcgtggacacgttggtcgagacggacgttcggccggccgacgcgggcctgaccgagaaggctctccatcggctcgacgacggccggctcatcgagtcggtattgatgcgctatcccgcgcgcgggccgcggcgctggcgggcaacggcgtgcatctcaagccaggctggctgcgcagtaggctgcccattctgcgcgactggcgagcttggcttcatgcgcgacctcgaggtgtctgagatcgtcgaccaggcgcgctactggcgccgccgcctggccgccgagggacgccggctgaccaatctcgtgttcatgggcatgggcgaaccgctgctcaaccccgaccgcgtgctggccgctgcggaagcgctgtccgacgcgcgccgtttcgggcttggcgcgcgccacatcacgctcagcaccagcggcgtcgtgccggccatggagcggctgattgccctccggccccagtacaccctcgccgtttcgctgcacgctgcccggcccgacctacgcgacgtgctggtgccgctcaaccgccgctacccggttggcgacgtggtagccgccgccagcgcgtatgcgcgcctgaccggccgccgggtgagctacgagtacgtgatgatcgactcggtcaacgacacgccgcgcgacgcagccgagctgacccagctgctcggtggccgccatgcccacgtcaacttgattccgatgaaccccgtcgcgcacacgccatggcaggccagccccacttcccggatcgccgagttcgcgtcgcttctgcgctcgggcggcatccgcacgaccgtgcgccgcaatcgcggcttggagataggtgctgcatgcgggcagctggctgccgacagcgcaggcgcgccgccaccggccgcggtggcgcgacgtcgcgagctgctggtgctcaacagcgcagcggcgttggccgcacgaccggctgtttcgaggagctga

SEQ ID NO: 383 - protein, 1391 aa, Unknown
  Obtained from an environmental sample
  SIGNAL (1)...(35)
VLLRTPTARRGLAVATAAGVLATLIHAAAAPAAQAAPPPPTDAELAAEPTRHALTTEQFYFVLPDRFANGDPSNDTAGIPGGPLDHGYDPDDEGFYQGGDLRGLIENLDYIEGLGTTALWMAPVFENKPVQGEGDHASAGYHGYWITDFTRVDPHFGTNEELAELVGAAHERDIKVFFDVITNHTADVIHYDEGAYDYLSKGAFPYLDTEGRPFDDLDHAGAEDGGFPELDTASFPYTPVTSDAEADLKVPDWLNDPTLYHNRGDSSFAGESSLYGDFHGLDDLFTARPEVVEGMVEIYRTWVEDFGIDGFRIDTVKHVNMEFWTRWSAAMKEHAASLGHEDFFMFGEVYSSDVAEKARYVTEGGLNATLDFAFQEAARSFASQGGSAKRLSALFGEDHRYTTADTNAQQSVTFLGNHDMGRIGHFLRADNPDADEAELLERSRLAHELMFLSRGNPVIYYGDEQGFTGSGGDKAARATLFGSTTPLYLEDPQLGTDRTHAEDAHDTDHPLYRAIAALSALTREHPALRDGAQTERYAEDGAGVRAHTRTDADERVEYLVAANNAEDGRTVAVPTDTPGAVFEVLYGGVGDGSATPVTADADGVVELTVPALSTAVLRADRPLPDPQAAPAVELTAPDAGAHGVVELSAAVTGGALNRVAFAAQVGDGDWEVLGVSDAPPHRVTHTVPAGTSAGTPLRYRAVAVDSSGATAATGAETTAGAPPPERAPRAVSREWAVVHYHRPDGNYDDWSLWAWGDLHESESFEDWPHGRPFVGRDAFGAFARVRLAPDASELGYLIVDGDGTKDGDLDRVIDLSETGEVWIEQGEPEALTEAPEGVYPPADESRAVLRYHRPDGDYDGWGVHVWTGAAEPTDWSRPVPASEVDSFGAVYEIPLAEGATSLSYIIHRGDEKDLPADQSLDLRAVGYEVWIISGEETYLLPSGGAAPDLNPDRARAHWIDAETVVWPGVAPPGGSRQLIHHPEGAIALEDGALTDEGHWITTPPAGERDPRPGLTGLEPSDMGRWFAERGQPGYRARQLADHVWQACAIRADELRTLPAALRTDIEDSFRVDTLVETDVRPADAGLTEKALHRLDDGRLIESVLMRYPARGPRRWRATACISSQAGCAVGCPFCATGELGFMRDLEVSEIVDQARYWRRRLAAEGRRLTNLVFMGMGEPLLNPDRVLAAAEALSDARRFGLGARHITLSTSGVVPAMERLIALRPQYTLAVSLHAARPDLRDVLVPLNRRYPVGDVVAAASAYARLTGRRVSYEYVMIDSVNDTPRDAAELTQLLGGRHAHVNLIPMNPVAHTPWQASPTSRIAEFASLLRSGGIRTTVRRNRGLEIGAACGQLAADSAGAPPPAAVARRRELLVLNSAAALAARPAVSRS

SEQ ID NO: 384 - DNA, 1434 bp, Unknown
  Obtained from an environmental sample
atgcacgcaggcgcaaacgaccgtacgatacgggttcccgtctctcgcccacctcggcgcacgtggtggatcgtcgcgctgctgctgctggtgtcggcatcggcgcaggccgatgcggtattgcacgcattcaactggcgctatgccaccgtcgaggcacgtgcaaacgagattgccgcgctcggttatcgcgccgtgctcgtcgccccgccactgcgctcgcagggcaacgaatggtgggcccgctaccagccgcaggactaccgcgtcatcgagcacccgctcggcgacaccgacgcgttcgtgcgcatggagtccgcgctgcgccaggccggcgtgcggctgtatgccgacatcgtgctgaaccacatggcgaacgaatcgggctggcgttctgatctgaactaccccggcacgctggtgctgaaccagtacgccgccaacccgagccgctatgcgcgtctgcgcctgttcggcgacctgcgctacaacttcctgtcgcaacacgacttcggcccggcgaactgcatcaccgactacggcagcgtgtggcaggtgcagacctggcggctgtgcggcgccgcgcccgatgtcggcctgccggatctggtcgacaacgactgggtggtgtcgcagcagcaacagtacctgcgctcgctgaaggcgctcggtgtcagcggtttccgcatcgacgccgccaagcacatgccgaacacgcacatgaaccgggtgctgacgtcgaacatcaagcagggcgtgcacgtgttcggcgagatcatcaccgacggcggcgtcggcgacacgtcatacgaccgcttcctggcgccgtatctcgcccagaccgaccacggcgcgtacgacttcccgttgttccaccagatccggaacgcgttccggcccggcggcagcatgaacctgctggtcgaccccggtgcctacgggcaggccctgccgcggcaccgtgcgatcaccttcacggtcacgcatgacatccccaacaacggcatcttccgctacctgatcctcgaccgcaccgacgagacgctggcctatgcctatgtgctcggccgcgacggtggcgtgccgctgatctattccgacaacaacgaaagcggcgacaaccgctgggtgaacgcctatcggcgctcggatctggcgcagatgatccgctttcacaacagcgtgcagggcagcgacatgcaggtgctgtcgtatggcagctgccatctgctgttccgccgcggcaaccgcggcatcgtcggcatcaacaagtgcggcagcagcgtgaatgcgaccgtgaacatgcacggcagcgtgctgtggtggtacaccgactaccgcgacgtgctgggctcgggccatgtggtcaacatcggcagcggcagctacacgttcactctgcccgcgcgtgcggcgcggatgtggttgcgctga

SEQ ID NO: 385 - protein, 477 aa, Unknown
  Obtained from an environmental sample
  SIGNAL (1)...(37)
MHAGANDRTIRVPVSRPPRRTWWIVALLLLVSASAQADAVLHAFNWRYATVEARANEIAALGYRAVLVAPPLRSQGNEWWARYQPQDYRVIEHPLGDTDAFVRMESALRQAGVRLYADIVLNHMANESGWRSDLNYPGTLVLNQYAANPSRYARLRLFGDLRYNFLSQHDFGPANCITDYGSVWQVQTWRLCGAAPDVGLPDLVDNDWVVSQQQQYLRSLKALGVSGFRIDAAKHMPNTHMNRVLTSNIKQGVHVFGEIITDGGVGDTSYDRFLAPYLAQTDHGAYDFPLFHQIRNAFRPGGSMNLLVDPGAYGQALPRHRAITFTVTHDIPNNGIFRYLILDRTDETLAYAYVLGRDGGVPLIYSDNNESGDNRWVNAYRRSDLAQMIRFHNSVQGSDMQVLSYGSCHLLFRRGNRGIVGINKCGSSVNATVNMHGSVLWWYTDYRDVLGSGHVVNIGSGSYTFTLPARAARMWLR

SEQ ID NO: 386 - DNA, 1458 bp, Unknown
  Obtained from an environmental sample
atgaaaaatagcaacgccttaaaaaatatcttattatcgtcagttattttaacttcaggactactcgcgcaagccaatccgcgcacagtgatggtgcatttatttgaatggaagtggaatgatatcgctcgtgagtgcgaaacgtacttaggcccaaacggctttgctgcaattcaagtttcgccgccgaacgagcatgcggttgttaccgggcgcccgtggtacgaacgttaccaaccggtgtcgtatattttaaattcacgcagcggcaaccgcgaagaatttattaacatggttaaggcttgtaaaaaagcaggtgtggatatttatgtcgatgcagtgattaaccatatgaccggaactttagcgcacggtgaagagcgtgtgggtatttcaggctcacgctttggccgttttgcttatccggattattcttacgatgactttcaccattgcggtcgcaacggtaatgatcagatcagtaattatggtgacagatatgaagtgcaaaactgtgcgctggttggtcttgcagatttaaacatcgaaaaagattatgtgcgcgaccgtatcgccagatatttaaatgaattagtcgatattggtgtggctggatttcgcatagatgccgccaagcatatgtcgactaactcgttaaatgaaattattaaacgtgtaaaaggcaacgcttatatttatcaggaagtgattgatcaaggcggtgagccgattcaggccaaagagtattttaataatggtgatgtgacagagtttaaatattcggtggatatgtcgcgtgtgatgttaaacggaaaactaacctggttaaatgataaggcccagtttggtgaaggctggaactacatgccatcagataaagcggtggtgtttattgataaccatgataaccaacgcggtcatggcggcggcggacatattttaaactataaagacggacgtaattatgagttggccagtgtactgatgcttgcatggccttacggttacccacaggtgatgtcgagctttgcgtttaccgatccaaactcgtcaccgccggctgatagtgaaggtaatacgaaagatacgaattgcctttctcgtgcagaggggccgggcgctcaggatggttgggtgtgtgaacaccgttggccgatgattcgtgaaatggttaaattcagaaatgtgaccagcagtaagttttatttatcgaactggtggagtaacggtaataaccaaattgctttttcgcgcggtgatttaggatttgttgtaatcaaccacgaagagcaggtgttgcgtcaacgattgcaaaccggtttaactgcaggtgtctactgtgatgttttaagtcaaaattgtgaacgcacaattactgttaatgacaatggtgaagctgaaatcatcgttacgggtcaaaatgcagcggccatccatgcccagagtaaattgaagtag

SEQ ID NO: 387 - protein, 485 aa, Unknown
  Obtained from an environmental sample
  SIGNAL (1)...(25)
MKNSNALKNILLSSVILTSGLLAQANPRTVMVHLFEWKWNDIARECETYLGPNGFAAIQVSPPNEHAVVTGRPWYERYQPVSYILNSRSGNREEFINMVKACKKAGVDIYVDAVINHMTGTLAHGEERVGISGSRFGRFAYPDYSYDDFHHCGRNGNDQISNYGDRYEVQNCALVGLADLNIEKDYVRDRIARYLNELVDIGVAGFRIDAAKHMSTNSLNEIIKRVKGNAYIYQEVIDQGGEPIQAKEYFNNGDVTEFKYSVDMSRVMLNGKLTWLNDKAQFGEGWNYMPSDKAVVFIDNHDNQRGHGGGGHILNYKDGRNYELASVLMLAWPYGYPQVMSSFAFTDPNSSPPADSEGNTKDTNCLSRAEGPGAQDGWVCEHRWPMIREMVKFRNVTSSKFYLSNWWSNGNNQIAFSRGDLGFVVINHEEQVLRQRLQTGLTAGVYCDVLSQNCERTITVNDNGEAEIIVTGQNAAAIHAQSKLK

SEQ ID NO: 388 - DNA, 1662 bp, Unknown
  Obtained from an environmental sample
atgagccacatcctgcgtgccgccgtattggcggcggtcctgctgccgtttcccgcactggccgatcaggccggcaagagcccggccggggtgcgctaccacggcggcgacgaaatcatcctccagggcttccactggaacgtcgtccgcgaagcgcccaacgactggtacaacatcctccgccaacaggcctcgacgatcgcggccgacggcttctcggcaatctggatgccggtgccctggcgtgacttctccagctggagcgacggcggcaagtccggcggcggcgaaggctacttctggcacgatttcaacaagaacggccgctatggcagcgatgcccagctgcgccaggccgccggcgcgctcggcggtgccggggtgaaggtgctctacgacgtggtgcccaaccacatgaaccgcggctacccgaacaaggaaatcaacctgccggccggccagggcttctggcgcaacgactgcgccgacccgggcaactaccccaacgactgcgacgacggcgatcgtttcgtcggcggcgatgccgacctcaataccggccatccgcaggtctatggcatgttccgcgacgagttcgccaacctgcgcagccagtacggcgccggcggcttccgcttcgatttcgtccgcggcttcgccccggagcgggtcaacagctggatgaccgacagtgccgacaacagcttctgcgtcggcgagctgtggaaaggcccttctgaatatcccagctgggactggcgcaacacggcgagctggcagcagatcatcaaggactggtccgatcgggccaagtgcccggtgttcgacttcgccctcaaggagcgcatgcagaacggctcgatcgccgactggaagaacggccttaacggcaaccccgatccgcgctggcgcgaggtggcagtgacctttgtcgacaaccacgacaccggctactcgcccgggcagaacggtgggcagcatcactggccgctgcaggacgggctgatccgtcaggcctacgcgtacattctgaccagccccggcacgccggtggtgtactggtcgcacatgtacgattggggctaccgcgacttcatccgccagctgatccaggtgcgtcgcgccgctggcgtgcgtgccgattcggcgatcagcttccacagcggctacagcggcctcgtcgccaccgtcaccggcagtcagcagaccctggtggtggcgctcaattccaacctgagcaatcccggccaggtcgccagcggcagcttcagcgaagcagtcaataccagtaatggccaggtgcgggtctggcggaccggcgccggcagtggtggcggtgacaatggcggcggtgagcccggtgccctggtcagcgtgaacttccgctgcgacaacggtgtgacgcaacccggcgacagcgtctacgcggtgggcaacgtcagccagctcggcaactggagcccggcctctgcggtgcggctgaccgataccagcggctacccgacctggaagggccgcatctcgctgccggccggccagaacgtggaatggaagtgcctgatccgcaacgaggccaatgcaacgcaggtgcggcaatggcagggcggggccaacaacagcgtgaagcccaccgaaggtgccaacacggcggggcggttctag

SEQ ID NO: 389 - protein, 553 aa, Unknown
  Obtained from an environmental sample
  SIGNAL (1)...(21)
MSHILRAAVLAAVLLPFPALADQAGKSPAGVRYHGGDEIILQGFHWNVVREAPNDWYNILRQQASTIAADGFSAIWMPVPWRDFSSWSDGGKSGGGEGYFWHDFNKNGRYGSDAQLRQAAGALGGAGVKVLYDVVPNHMNRGYPNKEINLPAGQGFWRNDCADPGNYPNDCDDGDRFVGGDADLNTGHPQVYGMFRDEFANLRSQYGAGGFRFDFVRGFAPERVNSWMTDSADNSFCVGELWKGPSEYPSWDWRNTASWQQIIKDWSDRAKCPVFDFALKERMQNGSIADWKNGLNGNPDPRWREVAVTFVDNHDTGYSPGQNGGQHHWPLQDGLIRQAYAYILTSPGTPVVYWSHMYDWGYRDFIRQLIQVRRAAGVRADSAISFHSGYSGLVATVTGSQQTLVVALNSNLSNPGQVASGSFSEAVNTSNGQVRVWRTGAGSGGGDNGGGEPGALVSVNFRCDNGVTQPGDSVYAVGNVSQLGNWSPASAVRLTDTSGYPTWKGRISLPAGQNVEWKCLIRNEANATQVRQWQGGANNSVKPTEGANTAGRF

SEQ ID NO: 390 - DNA, 1497 bp, Unknown
  Obtained from an environmental sample
atgaaccgtcactcgacgggtgcctcgacgcacccgcagcagcctcgttttgcccgccgcctggcggagtgcatccacacacgtctggcttccgccatccgcagcgccgcccgggccctgcccggcatcgccgcgcttgcagccttcgccggcagcacgacgccggcccgggccgacgtcatcctgcacgccttcaactggcgctacgacactgtcgaagcacgcgccgccgagatccagtcgctgggctacaaggcggtgctggtggcgccgccgctgaagtcggagggctcggcctggtgggcgcgctaccagccgcaggactaccgcacgatcgaccatccgctgggcaacaagcagagcttccagcgcatgtcgaacgcgctgcgcgcacgcggcatccgcgtctacgccgacatcatcctcaaccacatggccaatgaggcggcccagcgcggcgacctcaactatcccggccagcgcatcctcaacgcctacgctgccaacaccagctactggaacaaccagcgcctgtttggcgacctgcgctacaacttcctgtcgcagtgggacttcggcccggccaactgcatcagcaactacaacgacgtctggcaggtgcagaactggcgcctctgcggcagcccaggcgacgccggcctgcccgacctgctcggcagcagctatgtggtcgggcagcagcgcagctacctgacggcactcaaggggctcggcgtcaccggcttccgcatcgatgccgccaagcacatgccgctctcgcacatcaacgcggtgctgacacccgagatcaagcagggcgtgcatgtgttcggcgaggtgatcaccaacggcggcgccggcgacagcgagtacaacggcttcctcgccccctacttgaacggcaccgaccacgcggcctacgactttccgctgttcggcagcatccgcaacgccttccgcttcggcggcagcatgaacgcgctggtcaacccgctggccgtcggccaggccctgcccaacagccgggctgtgacgttcaccgtgacccacgacatcccgaacaacggcggcttccgctacctgatcctcgaccccaccgacgagaccctggcctatgcctatgtgctgggccgcgacggcggcagcccgctgctgtactcggacaacaacgagagcggcgacaaccgctgggtcaacgcctaccgccgcagtgacctcgccgcgatgatccgcttccacaacgccgcccagggcagcgacatgcaggtgctgtcctacagcgactgccacctgctgttccgccgcggcaaccgcggcatcgtcggtatcaacaaatgcggcagcacggtcaacaccaccatcaacatgaacaacagcgtgctctggtggtacaccaattaccgtgatgttctggacgcgaacagcgtcgtcaacatcggcagcagcagctacaccttcagcctgccggcgcgcagggcgaggatgtggttgaggtag

SEQ ID NO: 391 - protein, 498 aa, Unknown
  Obtained from an environmental sample
  SIGNAL (1)...(58)
MNRHSTGASTHPQQPRFARRLAECIHTRLASAIRSAARALPGIAALAAFAGSTTPARADVILHAFNWRYDTVEARAAEIQSLGYKAVLVAPPLKSEGSAWWARYQPQDYRTIDHPLGNKQSFQRMSNALRARGIRVYADIILNHMANEAAQRGDLNYPGQRILNAYAANTSYWNNQRLFGDLRYNFLSQWDFGPANCISNYNDVWQVQNWRLCGSPGDAGLPDLLGSSYVVGQQRSYLTALKGLGVTGFRIDAAKHMPLSHINAVLTPEIKQGVHVFGEVITNGGAGDSEYNGFLAPYLNGTDHAAYDFPLFGSIRNAFRFGGSMNALVNPLAVGQALPNSRAVTFTVTHDIPNNGGFRYLILDPTDETLAYAYVLGRDGGSPLLYSDNNESGDNRWVNAYRRSDLAAMIRFHNAAQGSDMQVLSYSDCHLLFRRGNRGIVGINKCGSTVNTTINMNNSVLWWYTNYRDVLDANSVVNIGSSSYTFSLPARRARMWLR

SEQ ID NO: 392 - DNA, 2100 bp, Unknown
  Obtained from an environmental sample
atgccttcagggctcaagcatggcatcaatatccacgatgacaattctgtcacattcgtcctatatgctcaggacaaggacaaggccatgcatgagtattgctacctcgtaggtgattggaacaactgggagcgcactgccgagagttcgatgaagagggatacggaggccggttgctggtggctcaaggtcggaggatttgatccggcaaaggagtatagatataatttccgtctcggcaacccgcctgcatcagacatctgtgtcagcgatccatatacaagaatcgtctatgatcagtggaatgaccagtatcttgaaggtgttcctgcattccctgagggcgcgaaggctctcgtttctgcattccagataagcaaaccggcctactcatggaaggttacggacttcaagatagaggacaggaaggatctcgtgatctatgagatgctgttccgcgatttctcagcgacaaaggatatcgcaggagcggtcgccgggtttgatcacatcaagaacctcggtgtgaatgcagtccagctcatgcctattcaggaatttgacggcaacaacagttggggatataaccctaaccactatttcgcccttgacaaggcttatggaacgcttgacgagtacaagcagttcattgatctttgtcatgaaaacggcattgctgtgatcgtggatgtcgtctataaccacaccttcggttctcatacatgggcaaagatgtggtgggattccgcaaacaacagaactgcttccaacaatccttggtacaatgaattcccgacacatccgtacaatgtgggccatgacttcaatcatgagaatgagatggttgaccagcatgtgaaggaaagtcttgaattccttctcagggagtacaaggtggacggcttccgtttcgacctcaccaagggtttcacccagaagaagacagacccggatgttgcggcatggggacgttacgaccagagccgtgtggatatcctcaaggactatgcggaccatatctggtcggtgaagaatgatgctgtagttatcttcgagcatctttctgactgggacgaagaggaagttctcgcaaatcatggaatccagctttggagaaatgtaaataaagaatatagttcggctgtcaccggcggaacaggtgatttcaagaatatgcactctacctcaccgttcggcggatatgtgggatatatggagagccacgatgaggagcgtatatgctatggcgcttctgacgatgtatcttcgatcacatggggtgtcatcggacttggaaatgattgggacaacgacaaggagatgacggcagagaacggactgttcgttgtaaagaatgttacggttgccgccaatgacaagttcaagatccgcaaggccaaggaatggaatgacaactacaactacggtgctgccaatgataacttcaaactgacagtcggtcagggatacaagatgaccaatggaaacagttcaaaggacatgggcgtccctgttgcaggcaagtatgacatctggttcagccatgatattgccaccgtatggcttatgcctgccggccagaagccggattatactccgtcgacttccgtatcatctgaggatgccctcactgtagccatgcgtcgtgcaggtgcatctgccgccttcttcctcacagtgcctggacctaagatgatctggcagttcggtgagatcggatatgatctttcgatcaactatccttccggcactgaagatgacaggacaagcgaaaagccggtaaagaccgctgaatacatgaagaatcctgcacgcaagtctctctacgacacctatgcaggtctgttgaagttccgccgcgagaaccctcgcttctttgattctgatgcgaagttcgagtggactccttccggtgagatcaagaagatcacctgctctgtggacggcaagaccttccatgtagtgggtaacttctcgcagatggacaagtcatattcagttccgtcaggcagttggaaggattacttcaatggcggagaatctgtttcgggaaccattaccctcaagcagggtgagttcaggctcctgaccagcttctga

SEQ ID NO: 393 - protein, 699 aa, Unknown
  Obtained from an environmental sample
MPSGLKHGINIHDDNSVTFVLYAQDKDKAMHEYCYLVGDWNNWERTAESSMKRDTEAGCWWLKVGGFDPAKEYRYNFRLGNPPASDICVSDPYTRIVYDQWNDQYLEGVPAFPEGAKALVSAFQISKPAYSWKVTDFKIEDRKDLVIYEMLFRDFSATKDIAGAVAGFDHIKNLGVNAVQLMPIQEFDGNNSWGYNPNHYFALDKAYGTLDEYKQFIDLCHENGIAVIVDVVYNHTFGSHTWAKMWWDSANNRTASNNPWYNEFPTHPYNVGHDFNHENEMVDQHVKESLEFLLREYKVDGFRFDLTKGFTQKKTDPDVAAWGRYDQSRVDILKDYADHIWSVKNDAVVIFEHLSDWDEEEVLANHGIQLWRNVNKEYSSAVTGGTGDFKNMHSTSPFGGYVGYMESHDEERICYGASDDVSSITWGVIGLGNDWDNDKEMTAENGLFVVKNVTVAANDKFKIRKAKEWNDNYNYGAANDNFKLTVGQGYKMTNGNSSKDMGVPVAGKYDIWFSHDIATVWLMPAGQKPDYTPSTSVSSEDALTVAMRRAGASAAFFLTVPGPKMIWQFGEIGYDLSINYPSGTEDDRTSEKPVKTAEYMKNPARKSLYDTYAGLLKFRRENPRFFDSDAKFEWTPSGEIKKITCSVDGKTFHVVGNFSQMDKSYSVPSGSWKDYFNGGESVSGTITLKQGEFRLLTSF

SEQ ID NO: 394 - DNA, 1347 bp, Unknown
  Obtained from an environmental sample
atgcggacatcagtgttgtgcggagtggtcctgatccaacaggcccgtcgtttcgcttcgagaaaatcagttcatatccacgccagcagcacctgcagtcggttgcggcgctggcacatcgtcgcctcgctgctcgccagtacctggctggcgaccgagccggcgcaagcggccacggaacagaatcaagccagcagcgcgatactgttccagggttttcactggcactccgccaacggtagctggtacggcaatctgcagggcaaggctggcgatttgaaagacttgggcatcactcacgtctggttcccgccgccgtcggacgctgcgtcactggaagggtatctgccgcgccagctcaatgtgctgaacagcagttacggcagtgagacggcgctacgcaatgccatcagcgcgctgaccggccaaggcatcaagagcgtggccgatgtcgtgatcaatcaccgcgttggcaccagcaactgggccgacttcaccaatccgagctgggattgccgcgctgtggtcaacaatgacgaatggagcgggcgttgcggcaacggcgattccggtgacggctatggcgctgcccgcgatctggatcactcgcaaggctttgttcagaacgatctgaaaacctggctgtcgtcgcgactcaaaggcgttggtttttccggtattcgttacgactactcgaaaggctacggttccggttacgccggcctgtatcacgacgcaatgaatccgaacttctgcgtcggtgagatctggaccgatctggattacaacaatgtcgatgcgcatcgccagctgttgatgaattatgtcgacggcaacaatggcaaatgcggcgccttcgatttcaccagcaaaggtctgctcaatcaggcactgtgggccaacgaatattggcgactgcgcgcctgggatggcaaaccggctggtggcatcggttggtgggcgcagaagatggtgacgttcgtcgacaaccatgacaccggtccgtcgcagagttgcagtgccggccagaaccactggccggtgccgtgcggcaaagtgatgcagggttatgcctacatcctgagtcatcccggtattccgaccgtgtattacccgcacgtctatgactggaacctgcgcagtgccatcaagaccctgatcagcctgcgcaaggagaagggcatcacctcgaccagcagcgtcgcgatccagcgcgccgatcaaggcctctatgccgccatcatcaacggcaatctggcgatgaagatcggcccgaacagctggagtcccggcagcggctggacgctgcgcatgtctggcgaacagtacgcaatttggacccgttga

SEQ ID NO: 395 - protein, 448 aa, Unknown
  Obtained from an environmental sample
  SIGNAL (1)...(57)
MRTSVLCGVVLIQQARRFASRKSVHIHASSTCSRLRRWHIVASLLASTWLATEPAQAATEQNQASSAILFQGFHWHSANGSWYGNLQGKAGDLKDLGITHVWFPPPSDAASLEGYLPRQLNVLNSSYGSETALRNAISALTGQGIKSVADVVINHRVGTSNWADFTNPSWDCRAVVNNDEWSGRCGNGDSGDGYGAARDLDHSQGFVQNDLKTWLSSRLKGVGFSGIRYDYSKGYGSGYAGLYHDAMNPNFCVGEIWTDLDYNNVDAHRQLLMNYVDGNNGKCGAFDFTSKGLLNQALWANEYWRLRAWDGKPAGGIGWWAQKMVTFVDNHDTGPSQSCSAGQNHWPVPCGKVMQGYAYILSHPGIPTVYYPHVYDWNLRSAIKTLISLRKEKGITSTSSVAIQRADQGLYAAIINGNLAMKIGPNSWSPGSGWTLRMSGEQYAIWTR

SEQ ID NO: 396 - DNA, 1644 bp, Unknown
  Obtained from an environmental sample
atgaaaaaaaccatcttattaaccaccatttgcatcctattatggaattgtcaatccaaaaaaaacatgaccgaacaagcaccttttgattggaaagcagccaatgtgtattttttactcaccgatcgctttgcaaacggagaccctagcaatgacaacctcatcaaaagagatttgccaacaggggttttacgtggttttatgggaggagatttaaaaggcatcacccaaaaaatagaagaaggttattttaccaacttaggcatcaatgccatttggatgactccgattgtagaacaaattcacggtgcagtggatgaaggcaccggaaacacctatggttttcatggctattggaccaaagattggacagctattgaccctaattatggcaccaaagccgatttaaaagaattggtagaaaaagcccatgccaaaggcattcgaattgtattagatgcagtaatcaaccacactggtccggttaccgaattagatccggtgttcccagatagttgggttagaaccaaacctaaatgtacttacgacacgtataaaaattatatcgattgtacgttagtagaaaatcttcccgacatcaaaaccgaaagcaatgaagaagtagaattgccaccaatgttagtggaaaagtggaaaaaagaaggcagatatgaagaagaaataagagaattagatgctttttttgccaaaaccggttatccaagagcaccaaaatactacatcatgaaatggttggcagattacatcaccgactttggtattgatggttacagagtggatacggttaaacacaccacagaagatgtttgggcagattttgcaaaagtttgtaaagatgcttttacagcttataaaactgcaaatcctaaaaaagtgctagacgataacgacttctttttggttggagaagtatatggttatggtttgcatggcaaacaaatctatgattttggagataaaaaagtgaattattttgaaaacggattcaactttttaatcaattttgattttaaaggagatgccaacaaagggtatgaagaattgtttagctattacgataaagttttgcaaaacgaaatgggcaactatagtgtgatgaattacttaacttctcatgacgatggttggccttttgacaaaaaaagagaacgtacttttgaagcagctaccaagttactgctttctcctggagtggcacaagtatattatggagatgaaactgcaagatctttagaaattgaaggcacccaaggagatgccactttgcgaagttttatgaattgggaagaggttcaaagtaatgctaaaaccaaagcattattagttcattatcaaaagttagggtcatttagagcaaaccacccggcagttggagcaggtaaacacgaaaaaattagcgatgcaccttatactttttccagaacttatcaaaaaggtgatttcaaagatgtcatagtaattactttagacgcttcaaaaggtgccaaaaccatccaagtaaataatgcatttgcagagggcagtaaagttagagatgcttattcaggaatgattggagaagtaaaaaatggtaaagtagagatccattctaacgaaactatcgtgttgttagaaaaaatgtaa

SEQ ID NO: 397 - protein, 547 aa, Unknown
  Obtained from an environmental sample
  SIGNAL (1)...(19)
MKKTILLTTICILLWNCQSKKNMTEQAPFDWKAANVYFLLTDRFANGDPSNDNLIKRDLPTGVLRGFMGGDLKGITQKIEEGYFTNLGINAIWMTPIVEQIHGAVDEGTGNTYGFHGYWTKDWTAIDPNYGTKADLKELVEKAHAKGIRIVLDAVINHTGPVTELDPVFPDSWVRTKPKCTYDTYKNYIDCTLVENLPDIKTESNEEVELPPMLVEKWKKEGRYEEEIRELDAFFAKTGYPRAPKYYIMKWLADYITDFGIDGYRVDTVKHTTEDVWADFAKVCKDAFTAYKTANPKKVLDDNDFFLVGEVYGYGLHGKQIYDFGDKKVNYFENGFNFLINFDFKGDANKGYEELFSYYDKVLQNEMGNYSVMNYLTSHDDGWPFDKKRERTFEAATKLLLSPGVAQVYYGDETARSLEIEGTQGDATLRSFMNWEEVQSNAKTKALLVHYQKLGSFRANHPAVGAGKHEKISDAPYTFSRTYQKGDFKDVIVITLDASKGAKTIQVNNAFAEGSKVRDAYSGMIGEVKNGKVEIHSNETIVLLEKM

SEQ ID NO: 398 - DNA, 2040 bp, Unknown
  Obtained from an environmental sample
gtgaccttcgtcttctacgatcaggatacggcaggaaagagccacaagtactgctacatcgtaggtgactggaacaactggacacgcgagacagagggagccatgtactacgatggaaccaagggctgctggtggatcactcttgacggcttcgacgctgacaaggagtaccgcttccagtatcgtctcggcaattcctcaggtactgacacctatgtcagcgacccatacacagagatcgtatatgaccagtggaatgaccagtatattcagggtgttcctgcattccctgaaggagcaaaggccctcgtttcggcattccagatcaatagacctgaatacagctggaagcacaaggacttcaaggtggaggacaagaacgacctcgtgatctacgagatgctcttccgcgacttcgctacatctcagaacattgccggtgcgatgacgcagctcgactatatcgagaacctcggtgtcactgcagtccagctcatgccgatccaggagttcgacggcaacctcagctggggatataaccctaaccactggttcgccctcgacaagtactacggtacacgtgagcagtacaaggagttcatcgacgagtgccacgctcgcggaatggctgtgatcatcgatgtcgtatataaccacgccacaggttcgcatccttgggcgaagatgtggtgggacggtgacaggactgccgcgaacaacccttggttcaacgagtacgcaaagcacccgtacaacgtatatcatgacatgaatcatgagaatgcgatggtcaaggagcatgtgaagaagagcctcgagtatctcctgacggagtacgacgtggacggattccgtttcgacctcacgaaaggcttcacccagaaggataccggcggagacaacggcgacgtggcagcgtggggacgttatgaccagagccgtgtggacatcctcaagggatatgccgaccacatctggtctgtgaacagtgatgctgtagtcatcttcgagcatctttccgactgggatgaggagaaagttctcgctgagcatggcatccagctttggagaaatgtgaacggagaatatcgttcagcggtgaccggcggaacaggaaacttcacgaatatgtattccaacgctccgttcggcggattcgtgggatatatggagagtcacgatgaggagcgtatctgctacggtgccggtgctgatgcatcttctgtgacatggggtgtgatcggtctcggtgacgactggaacaatgacaaggtaatgtctaaggacggtgtcttcttctcagtgaagaatgtgaccgtgactgcgaacgaccgtttcaagatccgcaaggcaggcgagtggaacgacgcatttaactacggtgcatctggcgacaacttcaagctcaccgtgggtcagggctacaagatgaccaacggtaacagctcgaaggatatgtatgtaccggctgcaggaacctacgatatctacttcagcctcgagactgagacagtatggctcatggctgccggtcagcgccctgccgatccttcgacaggcggcggagcttccgaggatgcccttacggtggcaatgcgtcgtgcaggtgcttctgcagcattcttcctcactgttcctggtccgaagatgatctggcagttcggtgagatcggatacgactattctatcgagtacaacgaccgcacaggtgagaagcctgtcgtgaccgaccagtacatggcagtccctgcccgcaaggctctctatgacacctatgcggctctcctgaagttccgtcgtgacaaccctcgcttcttcgacaaggatgcgaagttcgagtggactccttcaggcgagatcaagaagatcacctgctctgtggacggaaagaccttccatgtggtgggtaacttcgcgaagtcttcaaagacatacaccgttccttcaggcagctggaaggactacttcaataacggagcatcggtttcaggaaccatcaccctcaagcagggcgagttcagactcctgaccagcttctaa

SEQ ID NO: 399 - protein, 679 aa, Unknown
  Obtained from an environmental sample
MTFVFYDQDTAGKSHKYCYIVGDWNNWTRETEGAMYYDGTKGCWWITLDGFDADKEYRFQYRLGNSSGTDTYVSDPYTEIVYDQWNDQYIQGVPAFPEGAKALVSAFQINRPEYSWKHKDFKVEDKNDLVIYEMLFRDFATSQNIAGAMTQLDYIENLGVTAVQLMPIQEFDGNLSWGYNPNHWFALDKYYGTREQYKEFIDECHARGMAVIIDVVYNHATGSHPWAKMWWDGDRTAANNPWFNEYAKHPYNVYHDMNHENAMVKEHVKKSLEYLLTEYDVDGFRFDLTKGFTQKDTGGDNGDVAAWGRYDQSRVDILKGYADHIWSVNSDAVVIFEHLSDWDEEKVLAEHGIQLWRNVNGEYRSAVTGGTGNFTNMYSNAPFGGFVGYMESHDEERICYGAGADASSVTWGVIGLGDDWNNDKVMSKDGVFFSVKNVTVTANDRFKIRKAGEWNDAFNYGASGDNFKLTVGQGYKMTNGNSSKDMYVPAAGTYDIYFSLETETVWLMAAGQRPADPSTGGGASEDALTVAMRRAGASAAFFLTVPGPKMIWQFGEIGYDYSIEYNDRTGEKPVVTDQYMAVPARKALYDTYAALLKFRRDNPRFFDKDAKFEWTPSGEIKKITCSVDGKTFHVVGNFAKSSKTYTVPSGSWKDYFNNGASVSGTITLKQGEFRLLTSF

SEQ ID NO: 400 - DNA, 1245 bp, Unknown
  Obtained from an environmental sample
atgaaaaactttatcttgggaatggcggccatgctgatggccgcgcagagtctggccgccactgagcaaaacaaagcttcgacagccatcctgctccagggctttcactggaattcggcgaacgggtcctggtacctgaacctcgaaggcaaggccgcggacttccgggatcttggcatcacgcacgtctggtttccaccgccatcggactcgggagcgcgcgaaggctatctgcctcgggagctttataaacttcagtcggcctatggcagcgaggagcagctccgcaatgccatcagcgctctgaatcgggaaggcatccaggcggtggccgatatcgtaatcaaccatcgcgtcggcagctggaactggggagactttaactaccctaaatgggactgcgatagcgtcgcgaacaacgatgaatggcctggccgctgcggtggctatgattcgggtgccagctatggagccgcccgggacatcgaccattccaacgctcaggtgcagaatgatatcaaatatttcctgagcgaacgtctgcgaggggttggtttcagcggctggcgctacgattattccaaaggttatgcaccctattacgccaggatttataacgaagccagccgccctgacttttgcgtgggcgaagtctggcccggcttgaattatgatgatgtcaacgcgcatcgccaggagctgatgaattatgtcgacggcaccggaggaagctgtggagccttcgacttcacgagcaaaggacttctgaacaaggtccttcgtgacaatgactactggcgcctgcgcgatgccaatggacgtccggccggtggcatcggctggtggccgcagaagatggtgaccttcgtcgataaccatgatactggaccttccgaatcctgttcagcaggacagaacatgtggccggttccctgtgacaaggtgatgctgggctatgcctatatcctgactcatcctggagtgccgagcctttattatccgcatctttacgattggggtttgaagaatagcatcaagtctctcttgaatgcacgccgctccgtaggcattcaatccaactccaatatcagcattcaaaaagcagaaaacggactgtatgcagccatcatcagcggtcgttccggtcgtctggcgatgaagataggatctcaggattggaatcctggtgccggctgggatctcgtcacctggggcaaccagtacgcggtttggagtcaaaaataa

SEQ ID NO: 401 - protein, 414 aa, Unknown
  Obtained from an environmental sample
  SIGNAL (1)...(19)
MKNFILGMAAMLMAAQSLAATEQNKASTAILLQGFHWNSANGSWYLNLEGKAADFRDLGITHVWFPPPSDSGAREGYLPRELYKLQSAYGSEEQLRNAISALNREGIQAVADIVINHRVGSWNWGDFNYPKWDCDSVANNDEWPGRCGGYDSGASYGAARDIDHSNAQVQNDIKYFLSERLRGVGFSGWRYDYSKGYAPYYARIYNEASRPDFCVGEVWPGLNYDDVNAHRQELMNYVDGTGGSCGAFDFTSKGLLNKVLRDNDYWRLRDANGRPAGGIGWWPQKMVTFVDNHDTGPSESCSAGQNMWPVPCDKVMLGYAYILTHPGVPSLYYPHLYDWGLKNSIKSLLNARRSVGIQSNSNISIQKAENGLYAAIISGRSGRLAMKIGSQDWNPGAGWDLVTWGNQYAVWSQK

SEQ ID NO: 402 - DNA, 1995 bp, Unknown
  Obtained from an environmental sample
atgaactacaccgcacttgcggccagcctactgctgactgcctgcccggctttggccgcgcaaaaaactactttcgtgcatttattcgagtggcgctggtctgatattgccaccgaatgcgaaacatttttaggcccgcagggctttgctgctatccaggtgtcgcctccgacagagcatattcagggctcggcctggtggacccgctatcaaccggtcagctatgtggtacaaagccgcagtggtaacagagccgagtttatctctatggtgcaacgttgtaaggcggcaggcgtagatatttatgtcgacgctgtcatcaaccatatggccagcggcagtggtaccggcgttgctggcagcagttatggtaacaggcagtaccccatctacagcagccctgattttcataactcctgcaccattaacagcagcgactatggcaacgaccgctggcgggtgcaaaactgcgaactggtgggtttacccgatttaaataccagcgccagctatgtacaaaatagcctcgccgcttatctgaacgatatgctggcgataggggtaactggttttcgtattgacgccgccaagcatatggccagttcagatattgcaggcatcaaagccaaactcagcagagcaccactgatttaccaggaggtgatcgatcagggcggcgaggtgatcaccgccagcgagtacacaggcaatggcatggtgactgaatttaagtattcggtgcagctgggtaatgtgtttaaaaccggccggctggccagcctgtctaactttggtgaagcctggggttttttacctggcaatcaggcggtggtttttgtagataaccacgacaatcagcgcggtcatggcggtgcaggtaatgtcgtgacctacaaagatggcaaactctatgatctggccaatgtgtttatgctggcctacccctacggttatacccaggtcatgtccagttacgacttcacggatgcagacgctggcccgccttcagctgcagtgcataacaatggcagcctgaattgctttggcagtcagtggaaatgtgaacatcgctggagcaccatagcgggcgcagtgcagttccgcaacaatacggcggaggaatggcgggtgacccattggtgggataacggcaataaccagatcgccttcggccgtgctgctttaggttttgtcgctatcaataaagaaagttacaacctgagcacatcattacaaaccggtatgacagcaggcagttactgcaatgtgctcaaaggcagcatcagcaccgataaaaccagttgttcaggcgaagtgatccagataggcagcgatggccgtattcaggccaatctggcatcctgggatgcttttgccattcatcatcaggcgaaaattggcggcacagtgcagcctcctgcaggcaactggcagcgtactgtggtgtttattcaggcccaaactcaaactggccaggatatgtttgtccgcggtgggctggatcatgcagttgcgcaaagccagctcggcttaagctgcagcagtagcaattatttgtgcgccattcctatacggcatcgtaatctgaacaacgccactacagcaccatggaaagctaacgatggcttgctcgactggtatggccgcgaagccagccaaagcagcgccgctgaaggcacagcactggactggaccaccaacagctggccagcaagctggggcacagtccgcactgtggccacagatggctatggtgtggaggtactgaacagctttggccaacattactggatgctggatgtcgatatggattgcagcaaaaccatcaatggctggtttgaactcaaagcttatgtcaaaaacggccagggctgggaaggtaatatcagccagagcggcacgccttacgccagtcagaaccatatggcgcaatgcggtcagatgaatgtgtttagctttggtcaaaacagcgcacaaatcagcgccttgccctag

SEQ ID NO: 403 - protein, 664 aa, Unknown
  Obtained from an environmental sample
  SIGNAL (1)...(19)
MNYTALAASLLLTACPALAAQKTTFVHLFEWRWSDIATECETFLGPQGFAAIQVSPPTEHIQGSAWWTRYQPVSYVVQSRSGNRAEFISMVQRCKAAGVDIYVDAVINHMASGSGTGVAGSSYGNRQYPIYSSPDFHNSCTINSSDYGNDRWRVQNCELVGLPDLNTSASYVQNSLAAYLNDMLAIGVTGFRIDAAKHMASSDIAGIKAKLSRAPLIYQEVIDQGGEVITASEYTGNGMVTEFKYSVQLGNVFKTGRLASLSNFGEAWGFLPGNQAVVFVDNHDNQRGHGGAGNVVTYKDGKLYDLANVFMLAYPYGYTQVMSSYDFTDADAGPPSAAVHNNGSLNCFGSQWKCEHRWSTIAGAVQFRNNTAEEWRVTHWWDNGNNQIAFGRAALGFVAINKESYNLSTSLQTGMTAGSYCNVLKGSISTDKTSCSGEVIQIGSDGRIQANLASWDAFAIHHQAKIGGTVQPPAGNWQRTVVFIQAQTQTGQDMFVRGGLDHAVAQSQLGLSCSSSNYLCAIPIRHRNLNNATTAPWKANDGLLDWYGREASQSSAAEGTALDWTTNSWPASWGTVRTVATDGYGVEVLNSFGQHYWMLDVDMDCSKTINGWFELKAYVKNGQGWEGNISQSGTPYASQNHMAQCGQMNVFSFGQNSAQISALP

SEQ ID NO: 404 - DNA, 1653 bp, Unknown
  Obtained from an environmental sample
atgcgaaaaatagtccagctcctgatgatctctgccctacttgccctaagctgtgcccctaacaaggaggccactgccgttgaaaccccttttgtttgggagggtgccaatctgtatttcctcttggtggaccgctttcataacggcaaccccgataacgacaacatcatcccccgaaacgaagaaaccggggtgctgagaaattttatgggaggtgacctgcggggcatcattcaaaaaattgatgaaggctatttttccgaactaggcatcaacgccatctggatgactcccatcgttgaacaaatccacggagcggtagatgaaggcaccggaaacacctacggcttccacggctattggaccaaagactggaccaatatcgaccccagctatggcacccgcgaagacctgaaagaacttgttgaaaaagcccatgcacaaggcattcgcatcgtgttagacgccgtgattaaccacaccggaccggtaaccgaactcgatcctgtttggccggacacctgggtgcgaaccggccccaaatgtacctatgacagctacagcaattatatcgattgtacccttgtcgaaaacctgcccgacgtgcttaccgagagcaaagaacccgtagaactccccgaacacctcattgaaaaatggaaaaaagaaggccgttacgaacaggaaatcgctgaactcgatgccttttttgcccgtaccggttatccgagagcaccaaaatattacatcatgaaatggctttcagactacatcaccgactttggtattgacggttaccgtgtggacactgtcaaacacaccaccgaagatgtgtgggccgatttctccaaagtatgtaaagacgctttcgcacaatacaaaaaagacaatcccgataaggtacttgacgacaacgacttctttatgattggcgaagtctatggctatggcatccacgggaaaagaatctatgactttggcgataaacaagtggattactttgcccatggctttgacaacctcatcaactttgatttcaaaggagatgccaacaagccgtttgaagaattattctctaaatacaaccaggccgtgcaaaacgacctcaaaggcgtgagcatcatgaactacgtttcctcacacgacgacagctggccttttgacaaaaaaagagaacgcagctttgaagccggcaccaaactattgcttactcccggcatatcacaggtctattatggcgatgaaaccgcacgcagtcttgaaattcccggcactgtgggcgatgccaccctgcgttccatgatgaattgggacgacctccaaaacaaccccaacacccaacaagtgctcaaacacttccggctgctcgggcaattcagaaaaaaccaccccgctgtcggagccggagtacatcaggaaatttccaaagcaccgttctataccttcagcagaacctttacaaaaggagattacacagatacagtcatcatcggtttagacttgccatttggcaaaaaagaaatacaagtgtcctccatttttgaagacggaacagaactgcacgatgccttttcaggtattacaactaccgtaaaggacggtaaagcagtcatcgatagtcaaatgggcattgtgttattggagagaaaatag

SEQ ID NO: 405 - protein, 550 aa, Unknown
  Obtained from an environmental sample
  SIGNAL (1)...(26)
MRKIVQLLMISALLALSCAPNKEATAVETPFVWEGANLYFLLVDRFHNGNPDNDNIIPRNEETGVLRNFMGGDLRGIIQKIDEGYFSELGINAIWMTPIVEQIHGAVDEGTGNTYGFHGYWTKDWTNIDPSYGTREDLKELVEKAHAQGIRIVLDAVINHTGPVTELDPVWPDTWVRTGPKCTYDSYSNYIDCTLVENLPDVLTESKEPVELPEHLIEKWKKEGRYEQEIAELDAFFARTGYPRAPKYYIMKWLSDYITDFGIDGYRVDTVKHTTEDVWADFSKVCKDAFAQYKKDNPDKVLDDNDFFMIGEVYGYGIHGKRIYDFGDKQVDYFAHGFDNLINFDFKGDANKPFEELFSKYNQAVQNDLKGVSIMNYVSSHDDSWPFDKKRERSFEAGTKLLLTPGISQVYYGDETARSLEIPGTVGDATLRSMMNWDDLQNNPNTQQVLKHFRLLGQFRKNHPAVGAGVHQEISKAPFYTFSRTFTKGDYTDTVIIGLDLPFGKKEIQVSSIFEDGTELHDAFSGITTTVKDGKAVIDSQMGIVLLERK

SEQ ID NO: 406 - DNA, 1398 bp, Unknown
  Obtained from an environmental sample
atgaaaaacacagcgggaatctgggtgatcgcaggcatgctgatcgccccactggcgcaagccgatgtcatactgcacgccttcaactggaaatacagcgaggtcaccgccaaggccgacctcatcaagggggcgggctacaagcaggtgctcatctcgccccctctcaagtcctccggcaacgagtggtgggcccgttaccagccccaggatctgcggctcgtcgacagcccgctgggcaacaagcaggatctcgagcagctcatcgccgccatgcaggcccgcggcatcgccgtctatgcggatgtggtgctcaaccacatggccaacgagagctggaagcgcagtgacctcaactaccccggcagcgagctgttgcaaacctatgccgccaaccccgcctacttcgagcggcagaagctgttcggcgatctggcgcaaaaccttctgtcgggtcaggacttccaccccgagggctgcatcaccgactggagcgatcccggtcatgtccagtactggcgcctgtgtggcggcgccggcgacaaggggttgccggatctcgaccccaacaactgggtggtgagccagcagcaggcctatctcaaggcgctcaaggggatggggatcaagggctttcgggtcgatgcggtcaagcacatgagcgattaccagatcaacgccgtcttcacccccgagatcaagcagggcatgcacgtgtttggggaggtgatcacctccgggggcgccggcagcacggattacgagcgcttcctcaagccctatctcgacaacagcggccagggggcctatgacttcccgctgtttgcctccctgcgcggggcgctcggctatggcggcagcatgaatcagctggcggatcccggcgcctacggccaggccctgccgggcaaccgggcggtcaccttcgccatcacccacgacatccccaccaacgacggcttccgctaccagatcctgaaccagaccgacgagaagctggcctatgcctatctgctcggccgcgatgggggctcccccctggtctattcggatcacggcgagacccaggacaaggacggcctgcgctggcaggactactacctgcgcagcgatctcaaggggatgatccgcttccacaacgccgtgcagggtcagcccatgcagctcatcggcagcggcgactgcttcgtgctgttcaagcgcggcaagcaggggctggtcggggtcaacaagtgtgactacgagcaggagtactggctcgacaccgccaggttcgagctgaactggtatcgcaactacagggacgtgctggatcaaaatgccgtcatcaatgtgcagagccagtgggtacgggtcgccataccggcgcgcagcgcccgcctctggctgcaggaataa

SEQ ID NO: 407 - protein, 465 aa, Unknown
  Obtained from an environmental sample
  SIGNAL (1)...(21)
MKNTAGIWVIAGMLIAPLAQADVILHAFNWKYSEVTAKADLIKGAGYKQVLISPPLKSSGNEWWARYQPQDLRLVDSPLGNKQDLEQLIAAMQARGIAVYADVVLNHMANESWKRSDLNYPGSELLQTYAANPAYFERQKLFGDLAQNLLSGQDFHPEGCITDWSDPGHVQYWRLCGGAGDKGLPDLDPNNWVVSQQQAYLKALKGMGIKGFRVDAVKHMSDYQINAVFTPEIKQGMHVFGEVITSGGAGSTDYERFLKPYLDNSGQGAYDFPLFASLRGALGYGGSMNQLADPGAYGQALPGNRAVTFAITHDIPTNDGFRYQILNQTDEKLAYAYLLGRDGGSPLVYSDHGETQDKDGLRWQDYYLRSDLKGMIRFHNAVQGQPMQLIGSGDCFVLFKRGKQGLVGVNKCDYEQEYWLDTARFELNWYRNYRDVLDQNAVINVQSQWVRVAIPARSARLWLQE

SEQ ID NO: 408 - DNA, 1476 bp, Unknown
  Obtained from an environmental sample
atgccgtcgatgcccccgttgcacgcttcagcgtcagccccgctggccccgtcccccgctgcaccgcgcgcgacgtcgcgcctgcgccgtggcctggtacgcctcgccgccaccgcactgctggccttcggtgccatcggcggcgcgcaggccgatgtgatcctgcatgccttcaactggcgctatgccgacgtggaggcccgcgcctcgcagatccaggccgcgggctaccgcgcggtgctggtggccccggcgtacaagagcgagggcagcgcctggtgggcgcgctaccagccgcaggattaccggctgatccatcacccgctgggcgacaccaccgcgttccgcagcatggtcaatgcgctgaatgcgcgcggcatccgcgtgtacgcggacgtcatcctaaaccacatggccaacgagtcggcgcaacgcagcgacctgaactacccgggccagcgcctgctcaacctctacgccggcaacaccagctactacaacggccagcggctgttcggcgacctgcgctacaacttcctcagcagctgggatttcggccaggccacgtgcatcagcgactacaacgacgtgtggcaggtgcagaactggcgcctgtgcggcggcggtggtgacgccggcctgccggacctcgtcaacggcgactacgtggtgtcgcagcagcaggcctacctgcgcgcgctgaaggccatgggcgtgaagggcttccgcatcgacgccgcgaagcacatgcccatcgcccacctcaaccgggtgctgaccagcgacatcaagtcgggcatgcacatcttcggcgagatcatcactggcggcggcgcgggcaacggtgagtacgaccgtttcctcgcgccgtacctgcagtacaccgaccacggcgcgtacgacttcccgctgcacacgcagatccggggcgcattcggcttcggtggcagcatgagcaacctggtcgacccgcaggcctacgggcaggcgctggcggcggcgcgcgcggtcaccttcaccgtcacgcacgacatcccgaacaacagcggcttccgctacgcgctgatggaccccaccgacgaaaccctcgcgtacgcctacgtgatggggcgcaacggcggctccccgctgctgtactcggacaacaacgagagcggcgacaaccgttgggtcaatgcgtggaaccgtaccgacctcaagcagatggtgcgcttccacaatgcggtgcagggcagcgaccaggcggtgctggcgcacggcagctgctacctgctgttccgccgcggcagcctgggcatcgtcggcatcaacaagtgcggcagcccggtcaacgtcaccgtcaacatgaacaacagcgtgctgtggtggtacgccaactacaccgacgtgctcgattcgaccagcaaggtctatatcagcagcggaagccataccttcaccctgccggcgcgccgcgcgcgcctgtggctgaggtaa

SEQ ID NO: 409 - protein, 491 aa, Unknown
  Obtained from an environmental sample
  SIGNAL (1)...(51)
MPSMPPLHASASAPLAPSPAAPRATSRLRRGLVRLAATALLAFGAIGGAQADVILHAFNWRYADVEARASQIQAAGYRAVLVAPAYKSEGSAWWARYQPQDYRLIHHPLGDTTAFRSMVNALNARGIRVYADVILNHMANESAQRSDLNYPGQRLLNLYAGNTSYYNGQRLFGDLRYNFLSSWDFGQATCISDYNDVWQVQNWRLCGGGGDAGLPDLVNGDYVVSQQQAYLRALKAMGVKGFRIDAAKHMPIAHLNRVLTSDIKSGMHIFGEIITGGGAGNGEYDRFLAPYLQYTDHGAYDFPLHTQIRGAFGFGGSMSNLVDPQAYGQALAAARAVTFTVTHDIPNNSGFRYALMDPTDETLAYAYVMGRNGGSPLLYSDNNESGDNRWVNAWNRTDLKQMVRFHNAVQGSDQAVLAHGSCYLLFRRGSLGIVGINKCGSPVNVTVNMNNSVLWWYANYTDVLDSTSKVYISSGSHTFTLPARRARLWLR

SEQ ID NO: 410 - DNA, 1875 bp, Unknown
  Obtained from an environmental sample
atgaaaaatacaagcctgaccctgttagcaggctgcatggccctggcgtttaacgcccaggccgcagtcagccaaaataaccctgacatcatgttgcaaggcttccactggaactccgccaaagcgggtggctggtacaacaccctgcaaggcaatgtgaacgaaatcgccagcgccggcttcaacatggtgtggctgccgcccccctcgcaggccggctcactggaaggttacctgccggagcagtacaacaacctcaactccaactacggcaccgaaactcagctgcgcaacctgctcagcgccctcaaggccaacaacgtcaaggccattgccgacatcgtcatcaaccaccgtaatggctctggcagctggtgtaccttcaccaacccggcctggggttttgatgccatcgtctctaacgacgaagcctggggcgcagccggctccaactgcagcggcacccgtggcgctgccgactctggtgacggctatcacgccgcccgcgacatcgaccacagcaaaacctatgtgcgcgacagccttaaagagtggatgaacgtccgcctcaaaggcgttggctttgacggctggcgctatgactacgtcaaagggttcagcggtgtctacgtcggcgaatataacgccgccaccaacccttacttcagcgtcggtgaatactggacctcgctctgctacaacggcgaagagtgctttcctggtggctcttctccagaatctcaccgccaggcccagatcaactgggtcgacaagaccaatggcaacagcgcggtctttgacttcaccaccaaagggctgctcaacaaagcgctggagacctacaactacagccacctgcgcgatgccaacggcaaaccggccggggtgatcggctactggccgtcgcgcgccgtgaccttcgtcgacaaccacgacactggcccgagcgaagtctgtggcaatgcccagaacaactggccggtgccgtgcgacaaggtgatgcagggttatgcctacatcctcacccacccgggtgtgccctcggtctactacgcccactacttcaactgggggctgggcagcgaaatcaagaagttgatgaaactgcgcaaagacatggggctgcactccgactccgccgtgaccatcgacaaggcgcagcagggcctctatgccgcttacatcggtggcaaggtggcagtcaaactgggtaatggttcctggtcgccgtcaggcgctggctggaccctggcccagagcggcactgattgggccgtgtggaaaaaagatgacggcaataacttcaagcgcactgtggtgctgatctacggcgaaactgctgccggtcaggacatgttcatccgcggtggtatcgaccacgcctatgccgcagccaacctcggcaagacctgcaccagcactaactacgagtgcgccattccgatcacccacaacaacctgcgcaacgccaccaccgcaccgtggaaggctaacgacaagtaccttgactggtacgacggtgtcgaagccggccagagcactgccgctcagggctctgccgctgactggaccaccaacgtgtggccgtcgacctggggcgccgtcaagactgtggctgccgatggtttcggtgtagaaccgctcaacacctacggtcagcactactggatgctggatgtacagatggattgctccaagaccgtccaaggcatctggttcgagttcaagaccttcatcagcaacggcccgggttgggaagccaacgtcgcccagagcggtaccccgtacgccagcggtaaccactttggccagtgcggtaaggtcaacgtgttcaagcgcggcgtcagcgccccggtggctatcagagacttctga

SEQ ID NO: 411 - protein, 624 aa, Unknown
  Obtained from an environmental sample
  SIGNAL (1)...(21)
MKNTSLTLLAGCMALAFNAQAAVSQNNPDIMLQGFHWNSAKAGGWYNTLQGNVNEIASAGFNMVWLPPPSQAGSLEGYLPEQYNNLNSNYGTETQLRNLLSALKANNVKAIADIVINHRNGSGSWCTFTNPAWGFDAIVSNDEAWGAAGSNCSGTRGAADSGDGYHAARDIDHSKTYVRDSLKEWMNVRLKGVGFDGWRYDYVKGFSGVYVGEYNAATNPYFSVGEYWTSLCYNGEECFPGGSSPESHRQAQINWVDKTNGNSAVFDFTTKGLLNKALETYNYSHLRDANGKPAGVIGYWPSRAVTFVDNHDTGPSEVCGNAQNNWPVPCDKVMQGYAYILTHPGVPSVYYAHYFNWGLGSEIKKLMKLRKDMGLHSDSAVTIDKAQQGLYAAYIGGKVAVKLGNGSWSPSGAGWTLAQSGTDWAVWKKDDGNNFKRTVVLIYGETAAGQDMFIRGGIDHAYAAANLGKTCTSTNYECAIPITHNNLRNATTAPWKANDKYLDWYDGVEAGQSTAAQGSAADWTTNVWPSTWGAVKTVAADGFGVEPLNTYGQHYWMLDVQMDCSKTVQGIWFEFKTFISNGPGWEANVAQSGTPYASGNHFGQCGKVNVFKRGVSAPVAIRDF

SEQ ID NO: 412 - DNA, 2088 bp, Unknown
  Obtained from an environmental sample
gtggacgcacgcaccggcgagcggcgtgccgcgttggccgcgctcccggggcgcgagcgcgtcgtgctcgagcgcgcgacgccggagatcgacggcgggcgcttcgccgcgaagcgcgtgctcggtgacgccgtcgtcgtcgaggtcgatgcgttcgcggacggccacgaccgcgtcgcgtgcgcgctgcggtggcggcacgaggaagacgccgcgtggcgcgaggcgccgatggaggcgctcgcgaacgatcggtggcgtgcgacgttcgcggtcgatcgcctcgggcgctggcggtatgcgttcgccgcgtggatcgatcgctacgggacgtgggtgcacgacctcgcccggcgcccgctcgccgacgccgatctgcccgcgacgttcgcagccggagcggcgctcgtgcgcgaggccgccgcgggcgcgcaagggcacgcggccgagcgactgcgcgaggtcgccgcgctgctcggcggcgaggccgcggagagcgcgaagcgcgcggtcgcgtcgagtgcggacacgtgcgcgctgatgcgcgagcacgacccgcggctgcacgcggcggactacggtcgcgtgctggaggtgatcgtcgatccgccgctcgcgcgttgcagtgcgtggtacgagttcttcccgcgctcgttcggcgtcgcagagggagcggcgccaggcacgcccgcgcgaacgccgccgagtgcgtcggcgaccggcgcgttgcgccacggccggttccgcgacctcgagccgatgctcgactacgtcgcgcggctcggcttcgacgtgctgcacttcccgccgatccatccgatcggccgcgcgttccgcaagggtccgaacaacgcgctcgcggcgggacccgaggacgtcggcagcccgtgggcgatcgggctgcgcggcgcgggcggcgagggcgggcatcgcgccgtgcacccggagctcggcacgctcgaggacttccgctggctcgtggagcgcgcccgagcgcgcggcatcgagatcgcgctcgacgtcgcgttccagtgctcgccggaccacccgtacgtgcacgagcacccggagtggttccgtcgccggccggacggcagcatccagtacgccgagaacccgccgaagaagtaccaggacatctacccgttcgacttcgagtccgagcactggcccgcgctgtgggacgaactcgcgggcgtgttcgagttctgggtcgagcagggcgtgacgatcttccgcgtcgacaacccgcacacgaaggcgttcccgttctgggagtacgcgatcgcgcgcgtgaagagtcgctgcccgcaggcgatcttcctgtccgaggcattcacgcggccgaaggtcatgcaccggctcgcgaagctcggcttcacgcagtcgtacacgtacttcacctggcgcaacacgcggcacgagctcgtgcagtacttcaccgagctcgcgcacgggccgggagcggagtacttccggccgaacgcgtggccgaacacgccggacatcctgccggagtacctgcagctcggcggccgcgcggcattcatggtgcgcgcggtgctcgcgtcgctgctgtcgtcgaactggggcgtgtacggaccggcattcgagctgctcgagcacgagccgcgttccgccggcagcgaggagtacctcgactccgagaagtaccagctgcggcggtgggatctcgaccggccggacagcctcgcggagttcgtcgccgtgctgaaccgcatccggcgcgagtcgccggcgctgcagcagatggcgacgctcgcgttccacgacgccgacaacgagcagctgctgtgctggtcgaagaccgccggcgacgacgcgatcgtcgtcgtcgtgaacctcgacccgcaccacgcgcaggccggctggatcacgctgccgctcgagcgactcgggctcgagccggagcgcgcgtaccaggtgcacgacctgctcggcggcggacgcttcctctggagcgggccgcggaactacgtcgcgctcgcgccggacgcgctgccggcgcacgtgttccgcgtgcggcgacatgcgcgccgcgagcaggacttcgactacttcctctga

SEQ ID NO: 413 - protein, 695 aa, Unknown
  Obtained from an environmental sample
MDARTGERRAALAALPGRERVVLERATPEIDGGRFAAKRVLGDAVVVEVDAFADGHDRVACALRWRHEEDAAWREAPMEALANDRWRATFAVDRLGRWRYAFAAWIDRYGTWVHDLARRPLADADLPATFAAGAALVREAAAGAQGHAAERLREVAALLGGEAAESAKRAVASSADTCALMREHDPRLHAADYGRVLEVIVDPPLARCSAWYEFFPRSFGVAEGAAPGTPARTPPSASATGALRHGRFRDLEPMLDYVARLGFDVLHFPPIHPIGRAFRKGPNNALAAGPEDVGSPWAIGLRGAGGEGGHRAVHPELGTLEDFRWLVERARARGIEIALDVAFQCSPDHPYVHEHPEWFRRRPDGSIQYAENPPKKYQDIYPFDFESEHWPALWDELAGVFEFWVEQGVTIFRVDNPHTKAFPFWEYAIARVKSRCPQAIFLSEAFTRPKVMHRLAKLGFTQSYTYFTWRNTRHELVQYFTELAHGPGAEYFRPNAWPNTPDILPEYLQLGGRAAFMVRAVLASLLSSNWGVYGPAFELLEHEPRSAGSEEYLDSEKYQLRRWDLDRPDSLAEFVAVLNRIRRESPALQQMATLAFHDADNEQLLCWSKTAGDDAIVVVVNLDPHHAQAGWITLPLERLGLEPERAYQVHDLLGGGRFLWSGPRNYVALAPDALPAHVFRVRRHARREQDFDYFL

SEQ ID NO: 414 - DNA, 2262 bp, Unknown
  Obtained from an environmental sample
atgtcgatgcagatacgtacagacaaggctcaggagatcgatcgcaatgttgtgctcactatgcctgtcaaggcatacgagactgtaacggtcactaaggatggcctttcttctttccctgagattccgaatgcagatgaaccggcgactcttttctataaagcccctgcaggatctgtgtttgacggttatactaaagacttatatgctcatatcggagtcattgatggcgagtggaagcatgtggtttcggcatgggatgtagatgtggctaagtgcaaatggcataagacagcccaggataatgtatggtcacttacactcgagccttctatccgtgagtggttcgcttccggcacaactccagtgaatgtgatcggtgtagtggtaagagatgcaaagggagcaggaagccttcagacagaagacctgactcttaatgtgtatgaccctgtatatggaacaggtgatatgcctacaccgcttccggctggagtaaaacatggaataaatatcattgacaacaagaccgtaactcttgtgcttcttgagaaagataagaatggtggtcactatgatgagtgctaccttatcggaactgactttggcaaatggagcagggatgaaaaatacaagatgaacagggatgaggctgccggctgctggtggatcactcttaccggtcttaccaggacaaaggaatatatgttccagtacgaacttgtcaagggcaattcttcagttagggtgcatgatccatattctgagattgtttatgatatgtacaacgatcagtggacatacgcaagcaataagatacctaccggaaagacagacgggcttgtatcttcattccagatcagaaagtctacatattcatgggattaccctgattttgagattgaagatgaggatgaccttgtgatttatgaaatgcttgtaagagacttcaatacaagccatagcattagcgatgccatcgaccagctggattatatctcaggtcttggagtgaatgctatagaactcatgcctatccaggagtttgaggcaaacgagagctggggatatgctcctcattcatatttcgcattggataaatattacggtcaacctacagaatataagaaattcgtcgatgcatgtcatgcgaggggtattgcagtgattgtagatgtagtatacaatcatgctacaggtgctcatcctatggccaagatgtattggagcggtaatgctacatctgcatccaatccttggttcaatgtgacggcacctcatggtgacagtgtatatcatgactggaatcatagtaatgtcgatgttagaaatcatatcaagagaagccttgagtatctcatttctgaatataaggtggatggattcagatttgacctttcaaaaggtttcatccagagtggaaatgagtatgactggaatcaggacagaacaaactggataaaggaatattacaataccataaaggcagctgatccgaatgcagtggttattcttgagcattgggtggataatgagaattatgacctctgcaattatggaatgaaggtgtggaacaaggcatgtgaacagtattatcagtccggtatgggttactcttccgacagtgatttctcaggaatcagagagccttcatggttgcctttcggttcatatatatcattcatggagagccatgatgaagaaagagtcggcttcaagcagaaagagtatggtaacggcagtgtcaagacagatcttgctttgagaatgcgtcgtgcaggccttaatgcagcattcttccttactgttccaggtcctaagatgatatggcagttcggtgagatcggttatgatatcagtatcgatcacaacggacgtaccggaaacaagcctgtcgtgactgacgagtatctcgcaaacgagcataggaaggggctttatgatacgtatgccggtcttttggagttcagaaagaacaatccgcgtttctttgatgatgattccaacttccgttggggcgtttctacatcaaattggccaggacgttatatcatgaatacgtcaaaggagggtaagacttatgccatcttcggtaatttcggctctggaagtcagacaataacgatggaactcccttctgaaggcccttggtataactattacaacagcactgaggtgtggaacggaaagaaccataaaccgactctcaaagaaggtgaatttgtcttcctcgtagacgataagagtctgtgcaagaattga

SEQ ID NO: 415 - protein, 753 aa, Unknown
  Obtained from an environmental sample
MSMQIRTDKAQEIDRNVVLTMPVKAYETVTVTKDGLSSFPEIPNADEPATLFYKAPAGSVFDGYTKDLYAHIGVIDGEWKHVVSAWDVDVAKCKWHKTAQDNVWSLTLEPSIREWFASGTTPVNVIGVVVRDAKGAGSLQTEDLTLNVYDPVYGTGDMPTPLPAGVKHGINIIDNKTVTLVLLEKDKNGGHYDECYLIGTDFGKWSRDEKYKMNRDEAAGCWWITLTGLTRTKEYMFQYELVKGNSSVRVHDPYSEIVYDMYNDQWTYASNKIPTGKTDGLVSSFQIRKSTYSWDYPDFEIEDEDDLVIYEMLVRDFNTSHSISDAIDQLDYISGLGVNAIELMPIQEFEANESWGYAPHSYFALDKYYGQPTEYKKFVDACHARGIAVIVDVVYNHATGAHPMAKMYWSGNATSASNPWFNVTAPHGDSVYHDWNHSNVDVRNHIKRSLEYLISEYKVDGFRFDLSKGFIQSGNEYDWNQDRTNWIKEYYNTIKAADPNAVVILEHWVDNENYDLCNYGMKVWNKACEQYYQSGMGYSSDSDFSGIREPSWLPFGSYISFMESHDEERVGFKQKEYGNGSVKTDLALRMRRAGLNAAFFLTVPGPKMIWQFGEIGYDISIDHNGRTGNKPVVTDEYLANEHRKGLYDTYAGLLEFRKNNPRFFDDDSNFRWGVSTSNWPGRYIMNTSKEGKTYAIFGNFGSGSQTITMELPSEGPWYNYYNSTEVWNGKNHKPTLKEGEFVFLVDDKSLCKN

SEQ ID NO: 416 - DNA, 1344 bp, Unknown
  Obtained from an environmental sample
atgaaccgggttaagagactttcgattttggtcgttcttttccttaccgccttcattccgactgtttttgccggcgagcagcctctcgccatctttcacgcctttaacgaccccttcactcttgttgaatcctatgtctgcgaactcgccgggcagggatactcacatgtccagatatctccagcgcagaagtcgaaccctgctcgagcctggtatgcccggtatcaacccgtagattttactgtcatcgaagggatgggcactgagagcgatctgaggaagctcacggataaggcccacgcgtgtggaataaaggtgatcgccgatgtggtcttcaaccacatgtcgagcatggacgagtacaaggggcttgacaagtttccgggacttgctcctgctgatttccaccggcagtgcggcatcgattattcaaaacgagattcggtgcggaactgttggctcggaggcgacttgcccgatctggaccagtcccggccgagggtacaggatgttcagagagcccacataaggaagctcctttccctcggcatagacggcttccgcttcgatgcggctaaacacatcgaccccattgttgtgaaagactacatcgatctcatcgacagggagagcaacggcaggacctggaactacctcgaggtcatcgaggatgacggcactcaggccacggactacaactggatagcggcagtgaccgatttcgtcctctacaaggagtcgttgaggaaggccttcagtctcggcggggacctgcgatcgctcaagatgcctgtggctgtcaatgattcgcggagtatcgtcttcgggagaaatcacgacaccgtgccggagaataaccagaactgcatcgtcggctgctacgacagccgggaggactcctatcttgccacggcatacgtcctggcccgcgaatcgggagtcccgctggtcctcaactgggacaactacgacgcgccctacatcagcaccggcgtgaagttccgccagatcatgacgcagcgaggacgatcggccatgaacgtgaaggagaatgtgctgggcgtcatcgacagtcctgtcgtcatgatgatggagcgcgggagtgaaggctttttcgtcctcaacaagagcgccgaccggttcgatatcccagttctggatctgacactgaccaatctcgagggatgttatcgggagctgagaagaaaattcaccgtcgccatcgagagaaagtacggtaagaaatttgtcacccggtggggacgatgggaccgggggggcctcgaaatctacggccgcgacgctctctacttcatacgggaaccctgggagcagtgcaggtaa

SEQ ID NO: 417 - protein, 447 aa, Unknown
  Obtained from an environmental sample
  SIGNAL (1)...(24)
MNRVKRLSILVVLFLTAFIPTVFAGEQPLAIFHAFNDPFTLVESYVCELAGQGYSHVQISPAQKSNPARAWYARYQPVDFTVIEGMGTESDLRKLTDKAHACGIKVIADVVFNHMSSMDEYKGLDKFPGLAPADFHRQCGIDYSKRDSVRNCWLGGDLPDLDQSRPRVQDVQRAHIRKLLSLGIDGFRFDAAKHIDPIVVKDYIDLIDRESNGRTWNYLEVIEDDGTQATDYNWIAAVTDFVLYKESLRKAFSLGGDLRSLKMPVAVNDSRSIVFGRNHDTVPENNQNCIVGCYDSREDSYLATAYVLARESGVPLVLNWDNYDAPYISTGVKFRQIMTQRGRSAMNVKENVLGVIDSPVVMMMERGSEGFFVLNKSADRFDIPVLDLTLTNLEGCYRELRRKFTVAIERKYGKKFVTRWGRWDRGGLEIYGRDALYFIREPWEQCR

SEQ ID NO: 418 - DNA, 1455 bp, Unknown
  Obtained from an environmental sample
atgaaccgtccaggcacgggcgcctcggggcgcccacaatctcgctccgccacgtcgtggcaatcccgcaacggcggctggctgctcgcctcgctgctggccgtgtgtttcgcaacggcgcccgtgcgcgccgatgtcatcctgcatgcattcaactggccgtatgcgacggtcgaagcccgcgccaacgagctgcgagacctgggctatcgcgccgtactggtcgcaccgccggtgaagtccgaaggcaatgcgtggtgggcgcgctaccagccgcaggactaccgggtcatcgagcatccgctcggcaatcgcgagtcgttcgtgcgcatgtccagtgctctgcgcgcccgcggcattcgcgtctacgccgacatcgtgctgaatcacatggccaatgaagccccgcagcgaccggatctgaactaccccggtcaacgggtcctggatcagtatgcaggcaataccgcgtacttcgcgcagcaacgactctacggcgatctccgctacaacttcatgtcggcctgggactttggccccgcccactgcatcggcaactaccacgacgtctggcaggtgcagaactggcggctgtgcagcggcgctggcgatgccggcctgcccgacctgctggccagcgattacatcgtcggacagcagcgcacctatctccaggcactgaagaacctcggcgtctccgggttgcgcatcgacgcggccaagcacatgccgctcagccacatcaaccgcgtactgactgccgacctcaaggccggcatgcatgtgttcggcgaagtcatcacccacggtggcgtcggtgatcccgaatacgatctgtttctccggccctatctggatggcaccgatcacggtgcctacgacttcccgctcttcgaggcgatccgccgcgcattcggcttcggtggcagcatgagcaccctggtcgatcctggggccgtcggactggccctgcccaatgcccggtcgatcaccttcaccgtcacccacgacatcccgaacaatggtgtgttccggcatctgctgctggatgccggcgacgaaaccctggcgtacgcctacatcctgggtcgtgacggcggcagtccactgctgtactccgatcacaacgagagcggcgacaaccgctgggttcatgcctatcggcgcaacgacctcgcggccatgatccgctttcacaatgccaatcatggcaatgacatgcaggtgctcgcacacgggaactgccatctgctctttcgccgcggcaatcgcggcatcgtggcgatcaacaagtgcgggcatacggtcaacgccacggtgaacatgaacaacagtgtgctgtggtggcataccccgtatcgcgatgtccttgatgccggcagcgtggtgcagattggcagcgccagccacacgttcagccttccgccgcggcgcgctcggatgtggctgcgctga

SEQ ID NO: 419 - protein, 484 aa, Unknown
  Obtained from an environmental sample
  SIGNAL (1)...(44)
MNRPGTGASGRPQSRSATSWQSRNGGWLLASLLAVCFATAPVRADVILHAFNWPYATVEARANELRDLGYRAVLVAPPVKSEGNAWWARYQPQDYRVIEHPLGNRESFVRMSSALRARGIRVYADIVLNHMANEAPQRPDLNYPGQRVLDQYAGNTAYFAQQRLYGDLRYNFMSAWDFGPAHCIGNYHDVWQVQNWRLCSGAGDAGLPDLLASDYIVGQQRTYLQALKNLGVSGLRIDAAKHMPLSHINRVLTADLKAGMHVFGEVITHGGVGDPEYDLFLRPYLDGTDHGAYDFPLFEAIRRAFGFGGSMSTLVDPGAVGLALPNARSITFTVTHDIPNNGVFRHLLLDAGDETLAYAYILGRDGGSPLLYSDHNESGDNRWVHAYRRNDLAAMIRFHNANHGNDMQVLAHGNCHLLFRRGNRGIVAINKCGHTVNATVNMNNSVLWWHTPYRDVLDAGSVVQIGSASHTFSLPPRRARMWLR

SEQ ID NO: 420 - DNA, 1308 bp, Unknown
  Obtained from an environmental sample
atgcgttcatcagtgttgtgcggaggggcctggctgtattgggcccgtcgtttcgcttcgaacaagccagtcatcacccgtcgtcttggcgccgcacttgccggtctgctgttttgtgccggtgctcacgcggcgaccgaacagagcaaggccagtagcgcaatcctgttccagggctttcactggcactccgccaatggcagctggtacggcaacctgcagggcaaggccggtgatctgaaggatctcggcatcacccatgtctggttcccgccgccgtcggacgccgcgtcgctcgaaggctacctgccgcgccagcttaatgtgctgaactccagttacggcaacgaaaccgcgctgaagaacgcgattagcgcgctgaacggccagggcatcaagagcgtggttgacgtcgtgatcaaccatcgagtgggtacagccaactgggccgatttcaccaacccgacctgggattgccgcgccgtcaccagcaatgatgaatggagcggccgctgtggcaccgccgacaccggcgatggttacgatgctgcgcgcgatctcgaccaccgccagaccttcctgcagaacgatctcaagacttggctgtcgtcgcgtctcaaaggtgtgggcttcagcggcattcgctacgactactcgaaaggctacggaccgggttacgccgggctttaccacgatgcgatggcgccgaacttctgcgtcggcgagatctggaccaatcttgattacaacaatgtcgatgcccatcgccagctgctgatgaactacgtcgatggcaacggcggcaagtgtggcgcgttcgacttcaccaccaagggcctgctgaatcaggcgctgtcggccaacgaatactggcgcctgcgcgcttccgatggcaaaccggccggcggtatcggctggtgggcacagaagatggtgacctttgtcgacaaccacgacaccgggccgtcgcagagttgcggcagcggccaaaatcactggccggtgccctgcggcaaggtgatgcagggctatgcctacgtgctgagccatccgggtgttccgactgtgtactacccgcatgtctacgactggaacctgcgtgccgcgatcaagacgctgatccagctgcgcaaggaaaaaggcatcacctcgacctcgtcggttgcaatccagcgtgccgatcagggcctttacgcggcgatcatcaacaacaacctggcgatgaagatcggcccgaactcatggagtcctggcagcggctggacactgcgcacttccggcgatcaatacgcgatctggacccgctga

SEQ ID NO: 421 - protein, 435 aa, Unknown
  Obtained from an environmental sample
  SIGNAL (1)...(44)
MRSSVLCGGAWLYWARRFASNKPVITRRLGAALAGLLFCAGAHAATEQSKASSAILFQGFHWHSANGSWYGNLQGKAGDLKDLGITHVWFPPPSDAASLEGYLPRQLNVLNSSYGNETALKNAISALNGQGIKSVVDVVINHRVGTANWADFTNPTWDCRAVTSNDEWSGRCGTADTGDGYDAARDLDHRQTFLQNDLKTWLSSRLKGVGFSGIRYDYSKGYGPGYAGLYHDAMAPNFCVGEIWTNLDYNNVDAHRQLLMNYVDGNGGKCGAFDFTTKGLLNQALSANEYWRLRASDGKPAGGIGWWAQKMVTFVDNHDTGPSQSCGSGQNHWPVPCGKVMQGYAYVLSHPGVPTVYYPHVYDWNLRAAIKTLIQLRKEKGITSTSSVAIQRADQGLYAAIINNNLAMKIGPNSWSPGSGWTLRTSGDQYAIWTR

SEQ ID NO: 422 - DNA, 2751 bp, Unknown
  Obtained from an environmental sample
atgaaaacctcctactcctttgtatatacaatacttatcgtcttcgtacttattccgcttgcacctgttcgggtaagtgcacaagtagattttcgcgaagaaacgatttatttcctgctcacgacacgcttttttgacggcgattcgtcgaacaatgtacccaacgaatggtcgagctaccaccccgacccgaatatcaatccatcgattacagaccctcaggatgttacgtggcggggtgactttaaaggacttattcagaaactcgactacattcaggaccttggatttaccgcaatatggataacccctatcgtgcataatcgcagcccgctggactaccacggctaccatgcctgggactttacacgcgtggatccgcgcctggaatcacccggagccacctttcaggacctcatcaacgctgtacatgcccgggggatgaaaatcgtgctggatattgtaaccaatcactccggccggtttggaattaaggattttgccgaaatcaagtataataccgatcccaaccgcccatggggacaagacgcacagggcaaccccctgcaggacaaccccaactgggaatacgacggacttaccccaaaccccgatgatggcaaaatctggagtcgtgccaacctggccaggttacctgccccttataacgaaaacctggcggcctacaacttcccaaacaccataagctacgtgaataccaccagcccagactggtttcatcattccggaaacgggtttgcccagggcttcgacgatatcgaaaatctgcacaaccgcgccctgcacgaagacacgcccgacctcaataccagttccccccaggtgcgtcaatacttgctcgacgcctaccgtacctttattgaaatgggtgtggacggtttccgctgggacaccattaagcatatgagccgcagcgatgtcctgtggtttctggacgaattcaaaaagattaaccccgacctgttcattttcggcgaagtagcccaaaaacggcacgagctgcacaatgtagaagaaaccaatccacattggtacacatggagaggagaccccggcaactccgaaccctccgggatgtccgttatcgacttttttgccatggccaccttccacttgttcgaaaaaggcgagaatttttcgaatgtgatggcggccgcccgctacgaccatctgtatgccaaccccggcgaactggtcacgtttttggataaccacgacttcgggcccaacaacgactggaaccgccgctttggcggagatgcccgcaacctcactgccgccctcaactttatgtggacctggcggggaattccttccctttattatggcacagaagtccaatttatgcgtggcgcctttaccgacatacagtatggaggacatcagcgctccatcgacgaaaccggcagagcttattttggcgaacagttcgatgatgcacccaatcatatcgtctaccagcatatccgtaaactgaatgccatgcgacgcgctgttcctgccctgcaaaaaggctcctggcgctggggcggcaatggtggtgccaacggcgtcggcatcgtaagggaatacggcgatagctatgctgtagtcggtctagccaaagacggagcagtaaccttcaacttcaccaatattcgaaacggaacctaccgggatgccgttaccggccacgaaatatcggtctccaataactccatccgctttaccgtagccccttcctctgcaggaatttatgtactcaacggacccggccgcatcggcgatctcggtgccgggttcttccagtccgactccgagggaagtcagggcgatggcggagataatggaggcggtggcggaaatcaggaaccggccagcgtctccttcaacccaaatccacccgttattggtcagcaggtaaccttaacctacgatggtttcctgaactcccagcaacaggttaatctgcactggggctacgacggctggacaaacgtatccaccacgcctatgcagaaagacggcgacgtctggaaactgaccttcacgataccatcgaccgcgacctcccgactaaatttcgtattcaataacggaaacgatgtctgggataacaacaacagcaacaactattcggtaacgctggccagtcccgacggcagcaccccgcctcccgtatttaccgcgaatccggatcctgccgtggcgggagaacccctcaccctgacctatcagggctcgctggccggtgcatcggctgttaacctgcactggggctacgacggctggacgaacgtaaccaatacccccatgagcaaaagtggtgatgtgtggaccctcaccatgaccgttcccgccactgctacccgcgagctgaatttcgtattcaacgacgggaacaacacctgggacaacaacggaggccaggactacctgctcaacgtaaccaccaccacctcagccgacttcgaagacccgttccccaacgccttccggctgctgggcaactaccccaatccatttaaccccactaccagcatcagcttcgaaatacccgaaggaggcaccgtgcggattcagatcttcgacgtatccggcaggcttatcgaagagctctctgcggcctatccgggcgccggtgtgcatgccctgcgcttcgatgcacgccacctttctaccggtatgtacctgtaccgagccactttcggcggacacgtactaactggcaaaatgacactcgtcaagtaa

SEQ ID NO: 423 - protein, 916 aa, Unknown
  Obtained from an environmental sample
  SIGNAL (1)...(27)
MKTSYSFVYTILIVFVLIPLAPVRVSAQVDFREETIYFLLTTRFFDGDSSNNVPNEWSSYHPDPNINPSITDPQDVTWRGDFKGLIQKLDYIQDLGFTAIWITPIVHNRSPLDYHGYHAWDFTRVDPRLESPGATFQDLINAVHARGMKIVLDIVTNHSGRFGIKDFAEIKYNTDPNRPWGQDAQGNPLQDNPNWEYDGLTPNPDDGKIWSRANLARLPAPYNENLAAYNFPNTISYVNTTSPDWFHHSGNGFAQGFDDIENLHNRALHEDTPDLNTSSPQVRQYLLDAYRTFIEMGVDGFRWDTIKHMSRSDVLWFLDEFKKINPDLFIFGEVAQKRHELHNVEETNPHWYTWRGDPGNSEPSGMSVIDFFAMATFHLFEKGENFSNVMAAARYDHLYANPGELVTFLDNHDFGPNNDWNRRFGGDARNLTAALNFMWTWRGIPSLYYGTEVQFMRGAFTDIQYGGHQRSIDETGRAYFGEQFDDAPNHIVYQHIRKLNAMRRAVPALQKGSWRWGGNGGANGVGIVREYGDSYAVVGLAKDGAVTFNFTNIRNGTYRDAVTGHEISVSNNSIRFTVAPSSAGIYVLNGPGRIGDLGAGFFQSDSEGSQGDGGDNGGGGGNQEPASVSFNPNPPVIGQQVTLTYDGFLNSQQQVNLHWGYDGWTNVSTTPMQKDGDVWKLTFTIPSTATSRLNFVFNNGNDVWDNNNSNNYSVTLASPDGSTPPPVFTANPDPAVAGEPLTLTYQGSLAGASAVNLHWGYDGWTNVTNTPMSKSGDVWTLTMTVPATATRELNFVFNDGNNTWDNNGGQDYLLNVTTTTSADFEDPFPNAFRLLGNYPNPFNPTTSISFEIPEGGTVRIQIFDVSGRLIEELSAAYPGAGVHALRFDARHLSTGMYLYRATFGGHVLTGKMTLVK

SEQ ID NO: 424 - DNA, 2169 bp, Unknown
  Obtained from an environmental sample
gtggattctatgtttaagcaggtcaaacgtctattccttagcctggcgcttaccctgggcttactcaccggaagtgcgcttccgctagtccccgtctcccaggcctttgccgatcccgatactgcggtatccaataaggccagcttcagcaccgacgtcatttatcaagtttttaccgaccgctttctcgacggggatgcctccaataacccgaccggagcggcctatgactccaccggcaccaatctgaagctgtatctcggcggcgactggaaagggctgaccgataagctgaatgataattattttacggatctgggcattacggcactctggatctcccagcctgtcgagaatatttattcggttgtcaactattccggagtgaacagcacttcctaccatggctactgggcccgcgacttcaagaagaccaacccctatttcggctcgatggccgatttccagactctcgttaataccgctcatgcaaaaggcatcaagatcgtcatcgactttgctccgaatcatacctctcctgcaatggagaccgataccagcttcgccgagaacggcaaattgtacgacaacggcaccctgctgggcggctacacgaatgacacgaacggatttttccatcacaacggcggctccgatttctccacactggagaacggcatttacaagaacctttacgatctggccgatctgaatcacaataacagcacgattgacaagtacttcaaagatgcgatcaaggtgtggatcgatacgggcgtggacggcatccgcgttgatgcagtcaagcacatgccggacggctggcagaaaaactgggtatccagcatttacaactacgagcccgtgtttattttcggggaatggtacctcggttcgtcggctgccgatgcagataatacgaagttcgccaacacctcggggatgagcctgcttgatttccggttcaaccaggaggtgcggaacgtattccgcaatgacacctccaccatgtatgcactcgattccatgctcaccaatacagctgctgactacacccaggtcaacgatcaagtaacctttattgataatcatgatatggaccgcttcaagaccggcacgctgaacaaccgccgtctggagcaggctctggccttcactctgacctcccgcggcgttcctgccatttattacggaacagaacagtatatgaccggcaacggcgacccggacaaccgggcgatgatgacttccttctccacctctactaccgcgttcaatgtcatcagcaagcttgcgccgctgcgcaaatccaatccggccatcgcttacggcactacccagcagcgctggatcaacaatgacgtgtatatctatgaacgcaaattcggcaacaacgtcgctgtcgtagcggtcaaccgcaatctcagcacagcaacatccatcagcggactggttacttccttgccgtcaggaacctacagcgatgtgctgggcggcactttaagcggcaattccattaccgcaagctccggtaacgtcgccacctttacgctgggcgcaggcgcagcggcggtatggcaatacacggagacgagctcggccactcccgtgctcggccatgtcggcccgatgatggggcaacccggcaatgaagtaaccatcgacggacgcggcttcggctcgtctgcaggaacggtctatttcggcacaaccgccgtaaccggctcgaacattatttcgtgggaagatacacaaatcaaggtgaaggtaccttccgtagcggccggcacctacgcggttaaagtaacgaacagcgccggaacaagcaattcttacagcggctttaccattctcaccggcactcaggtttccgtacgctttatcgtgaacaacgccactacatcgcttggccaaaatgtatatctcaccggcaatgtagccgagctcggtaactggactacaggcagcagtgcaatcgggccgttgttcaaccagatcattaaagtctaccctacctggtattatgatgtcagcgttccggccggcactgcgctcgaattcaaatttttcaagaaaagcggttcgaccgttacctgggagagcggctctaatcatacgttcaccgctcctgcgagcggaaccgcaactgtaaccgtggattggcagtaa

SEQ ID NO: 425 - protein, 722 aa, Unknown
  Obtained from an environmental sample
  SIGNAL (1)...(37)
MDSMFKQVKRLFLSLALTLGLLTGSALPLVPVSQAFADPDTAVSNKASFSTDVIYQVFTDRFLDGDASNNPTGAAYDSTGTNLKLYLGGDWKGLTDKLNDNYFTDLGITALWISQPVENIYSVVNYSGVNSTSYHGYWARDFKKTNPYFGSMADFQTLVNTAHAKGIKIVIDFAPNHTSPAMETDTSFAENGKLYDNGTLLGGYTNDTNGFFHHNGGSDFSTLENGIYKNLYDLADLNHNNSTIDKYFKDAIKVWIDTGVDGIRVDAVKHMPDGWQKNWVSSIYNYEPVFIFGEWYLGSSAADADNTKFANTSGMSLLDFRFNQEVRNVFRNDTSTMYALDSMLTNTAADYTQVNDQVTFIDNHDMDRFKTGTLNNRRLEQALAFTLTSRGVPAIYYGTEQYMTGNGDPDNRAMMTSFSTSTTAFNVISKLAPLRKSNPAIAYGTTQQRWINNDVYIYERKFGNNVAVVAVNRNLSTATSISGLVTSLPSGTYSDVLGGTLSGNSITASSGNVATFTLGAGAAAVWQYTETSSATPVLGHVGPMMGQPGNEVTIDGRGFGSSAGTVYFGTTAVTGSNIISWEDTQIKVKVPSVAAGTYAVKVTNSAGTSNSYSGFTILTGTQVSVRFIVNNATTSLGQNVYLTGNVAELGNWTTGSSAIGPLFNQIIKVYPTWYYDVSVPAGTALEFKFFKKSGSTVTWESGSNHTFTAPASGTATVTVDWQ

SEQ ID NO: 426 - DNA, 2139 bp, Unknown
  Obtained from an environmental sample
atgattagaaaattcacaattgcgggtatcgttaacgagaatacgatccagtacaaggtaacgcccgaaacacttatctccgatattgaggacataaaagtgtacgacggcgatcgggagattaaggttaatgaaatctctactctcggtaagaaatccgttatgggatacgtaacgcttgacgagtcgcttgatctttcgaagaattacagaatagaggtgaaaggatacggctcgaagatcgctgttcctaccgatatttttgacagcgagtacttcgctgaaacgtaccactatgacggagacgatctcggagctgtgataaacggagatacaacaacatttaaggtttgggctccgactgcgtctgaggttattctcaatctctttgaaaaaggcgacggagtagaggcttacaagagcgtttcgatgactcgcggtgaaaagggcgtgtggtcacatacagaggaatgcggtcatggaacgtactatacttatactgtctcgacatccgcaggtgttcaggaagctgttgacccatatgctaaatccgcaggtgtgaacggaaaccgcggaatggttgttgacctttccctgacaaatcccgaaggatgggaaaacgatcagcttgagaataagatagagaagtattcagatgcaataatctgggaagtacacgttcgtgacttctcgaacaagatcgaatcttccgaatataagggcaagtaccttgcgttcacggagagaggtcttgttaacgagcacggtaaatctgtcggtgttgattaccttgtagaccttggtataacacacgttcatctgcttcctgtatatgactatgctacagtagatgaatcctcgactgagccgcagtttaactggggatacgacccgaagaattacaacgttcccgagggcagctattcaacagatccgtacaacggcgaggttcgtattcgcgagttcaaggaaatggtaaaggcactccacgaagcgggcattggtgttatcatggacgtagtatacaatcatactcatgacgcaaacagctcgttcaataagatagttccgtactactattacagatacacctcctcaggcgctaactcatctgcaagcggatgcggaaacgataccgcctccgagagatatatgtacggcaagttcatggttgagtccactgcatattgggtaagtgaatacaaccttgacggacttcgcttcgaccttatgggactccatgacgtagaaacgatgcaggaggttgagagtgcagttcacgccatcaatccgaatgcgatcatttacggcgaaggatggacaatgggcgcgactgttgacggaagcgctcaggcaaatcagtcaaatatctcaaagattacgcctacaggtgacgcgatcggtgcagtcgctgtattcaacgacgtgatcagagacggtctcaagggaagcgtatttgaaaaaacaggccgcggctttatcaacggatctgccaagaatacaataaacaaggttatgttcggtatcagaggcggtcagggtgttggtcagggctggacagttgaagacggaatggtcatcaactatatgagtgctcacgataacaatacgctgtgggataagctccttctctcgaatcctaacgtgagcgacgagaagagaaacgatatgaataaccttggcgccgcaatcatcatgatctctcgcggaactccgttctggcaggcgggagaggaaatgctccgcacaaagggaggagacgagaacagctacaagtccagtgatgaggtaaacaatatcaactggtccgtacttgctgacggtacgcgcgagtatgaaacaatgcagtattacaagggtctcatcgagatgcgtaaggcatacggattattctcagatatgacaaccgagatcactcacaccgactccggcaacggaatccttacaataagtatcaaagcacagaacggtgaagaagcactcgtaattattaatccgaacgagtttgagtacacgcatgagcttgacggcgagtggaaactcatatgtgacgctgaccgtgcaggtgcagaggttctcgaggctgagagcggaagcgttaaggttggcgcgatcagtattaaggtttacgtaaagtga

SEQ ID NO: 427 - protein, 712 aa, Unknown
  Obtained from an environmental sample
MIRKFTIAGIVNENTIQYKVTPETLISDIEDIKVYDGDREIKVNEISTLGKKSVMGYVTLDESLDLSKNYRIEVKGYGSKIAVPTDIFDSEYFAETYHYDGDDLGAVINGDTTTFKVWAPTASEVILNLFEKGDGVEAYKSVSMTRGEKGVWSHTEECGHGTYYTYTVSTSAGVQEAVDPYAKSAGVNGNRGMVVDLSLTNPEGWENDQLENKIEKYSDAIIWEVHVRDFSNKIESSEYKGKYLAFTERGLVNEHGKSVGVDYLVDLGITHVHLLPVYDYATVDESSTEPQFNWGYDPKNYNVPEGSYSTDPYNGEVRIREFKEMVKALHEAGIGVIMDVVYNHTHDANSSFNKIVPYYYYRYTSSGANSSASGCGNDTASERYMYGKFMVESTAYWVSEYNLDGLRFDLMGLHDVETMQEVESAVHAINPNAIIYGEGWTMGATVDGSAQANQSNISKITPTGDAIGAVAVFNDVIRDGLKGSVFEKTGRGFINGSAKNTINKVMFGIRGGQGVGQGWTVEDGMVINYMSAHDNNTLWDKLLLSNPNVSDEKRNDMNNLGAAIIMISRGTPFWQAGEEMLRTKGGDENSYKSSDEVNNINWSVLADGTREYETMQYYKGLIEMRKAYGLFSDMTTEITHTDSGNGILTISIKAQNGEEALVIINPNEFEYTHELDGEWKLICDADRAGAEVLEAESGSVKVGAISIKVYVK

SEQ ID NO: 428 - DNA, 1425 bp, Unknown
  Obtained from an environmental sample
atgcaagtaatcagtaccatgctaaagcgtcagctattgtggctggcattcgttgttagttcagctgtgttttcgtcggctgctgttgccgatgctattttgcatgcctttgactggcactatgatgaagttgctgctaaagcgacagaaataaaaaatctgggttacaaggcggtattggtagcgccgccgttaaaatcgaacgcgggtaattgtgcctggtggcagcgttatcagccgcaggatatccgtgtaattgatcattgcaaaggtaacaaacaatcgtttgtaaatatgatcaatgccctgaacgatgccaacccggcgcgtaaagttgatgtatacgccgatatcgtattaaaccatatggcaaatgagcgtaacggcgcgactgactttcccggccaggctgcagtaaatagctatggcagtaacagcagttactggaataaccagcgcctgtttggcaatttaacccaggggttgttcggcgccagcgactttaacccggctaactgtatcagcaactataacgatgtatggcaggtgcagaactggcggctgtgtggtggtgcgggtgatgccggtttgccggatctcaaccccaacagctgggtggtgcagcaacagcgtaactacttaactgcattaaaagacttaggcgtaaaaggctttagggttgatgcggccaagcatatgaccatttggcatattaatgaaattttcaccagcagcattaaaaatggcatgtacgtgtttggtgaaattattaccagcggtggagccggtaataacgaatacgatagcttcttatcgccttacctggcttataccgatcataaagcctacgattttccgctgtttagcgctattcgcagtgcctttggttttggcggtagcttaagccaactggttaacccgttgtctaacggccaggcgctgcaaaacagccgggcagtaacctttactattacgcatgatattcctaccaatgacggttttcgttatctgattatggatgctaccgacgagtatctggcctatgcctacattatgggccgtgatggtggtaaaccgctgatattcagcgacagcaccggcactgataacaaccgctgggttaatgcctataaagccgatcatattagcaaaatgctgaatttccataaccgtatgcaggggcagggcatggaaatgttagcctggaatgactgtgctattttgttccgccgcggccaggaaggcgtggtaggtattaataaatgcagcagcaaccagagctttaacattaacaccaacggccgcttttactggtaccgtaattaccgcgatgtgttaagtggcggtaatctggtgtatatcaatggcggcagttacaacttcagcattccggcgcgtcaggccagaatgtggtatgccgactaa

SEQ ID NO: 429 - protein, 474 aa, Unknown
  Obtained from an environmental sample
  SIGNAL (1)...(30)
MQVISTMLKRQLLWLAFVVSSAVFSSAAVADAILHAFDWHYDEVAAKATEIKNLGYKAVLVAPPLKSNAGNCAWWQRYQPQDIRVIDHCKGNKQSFVNMINALNDANPARKVDVYADIVLNHMANERNGATDFPGQAAVNSYGSNSSYWNNQRLFGNLTQGLFGASDFNPANCISNYNDVWQVQNWRLCGGAGDAGLPDLNPNSWVVQQQRNYLTALKDLGVKGFRVDAAKHMTIWHINEIFTSSIKNGMYVFGEIITSGGAGNNEYDSFLSPYLAYTDHKAYDFPLFSAIRSAFGFGGSLSQLVNPLSNGQALQNSRAVTFTITHDIPTNDGFRYLIMDATDEYLAYAYIMGRDGGKPLIFSDSTGTDNNRWVNAYKADHISKMLNFHNRMQGQGMEMLAWNDCAILFRRGQEGVVGINKCSSNQSFNINTNGRFYWYRNYRDVLSGGNLVYINGGSYNFSIPARQARMWYAD

SEQ ID NO: 430 - DNA, 1650 bp, Unknown
  Obtained from an environmental sample
atgtccctattcaaaaaaagctttccgtggattttatccctacttcttttgttttcgtttattgctcctttttccattcaaacagaaaaagtccgcgctggaagtgtgccggtaaatggcacaatgatgcaatatttcgaatggtaccttccagacgatggaacactatggacgaaagtagcaaataacgctcaatctttagcgaatcttggcattactgccctttggcttccccctgcctataaaggaacaagcagcagtgacgttggatatggcgtttatgatttatatgaccttggagagtttaatcaaaaaggaactgtccgaacaaaatacgggacaaaaacacaatatatccaagcaatccaagcggcgcatacagcagggatgcgagtatatgcagatgtcgtctttaaccataaagccggtgcagatggaacagaactagtcgatgcagtagaagtaaatccttctgaccgcaatcaagaaatatcaggaacatatcaaatccaagcgtggacaaaatttgattttcctggtcgtggaaacacctattctagttttaaatggcgttggtatcatttcgatggaacggactgggatgagagtagaaaactaaatcgtatttacaagttccgcggcacgggaaaagcatgggattgggaagtagatacagaaaacgggaattatgactatctcatgtatgcagatttagatatggatcatccagaggttgtatccgaactaaaaaattggggaaagtggtatgtaaccacaaccaatatcgacggattccgtctggatgcagtgaagcatattaaatatagctttttcccggactggctatcgtacgtacgaacccaaacacaaaagcctctttttgccgttggggaattttggagctatgacattagcaagttgcacaactatattacaaagacgaacggctctatgtccctattcgatgccccgctgcataacaatttttatatagcatcgaaatcaagcggttattttgatatgcgcacattactcaacaacacattgatgaaagatcagcctacattagcagtcacattagtggataatcacgatactgagccagggcaatctctgcagtcatgggtcgagccatggtttaaaccgttagcttacgcatttatcttgacccgccaagaaggttatccttgcgtcttttatggagattactatggtattccaaaatacaacattcctgcgctgaaaagcaaacttgatccgctgttaattgccagaagagattatgcctatggaacacagcacgactatattgacagtgcggatattatcggttggacgcgggaaggagtggctgaaaaagcaaattcaggactggctgcactcattaccgacgggcctggcggaagcaaatggatgtatgttggaaaacaacacgctggcaaaacgttttatgatttaaccggcaatcgaagtgatacagtgacaatcaatgctgatggatggggagaatttaaagtcaatggagggtctgtatccatatgggttccaaaaatatcaaccacttcccaaataacatttactgtaaataacgccacaaccgtttggggacaaaatgtatacgttgtcgggaatatttcgcagctggggaac

SEQ ID NO: 431 - protein, 550 aa, Unknown
  Obtained from an environmental sample
  SIGNAL (1)...(33)
MSLFKKSFPWILSLLLLFSFIAPFSIQTEKVRAGSVPVNGTMMQYFEWYLPDDGTLWTKVANNAQSLANLGITALWLPPAYKGTSSSDVGYGVYDLYDLGEFNQKGTVRTKYGTKTQYIQAIQAAHTAGMRVYADVVFNHKAGADGTELVDAVEVNPSDRNQEISGTYQIQAWTKFDFPGRGNTYSSFKWRWYHFDGTDWDESRKLNRIYKFRGTGKAWDWEVDTENGNYDYLMYADLDMDHPEVVSELKNWGKWYVTTTNIDGFRLDAVKHIKYSFFPDWLSYVRTQTQKPLFAVGEFWSYDISKLHNYITKTNGSMSLFDAPLHNNFYIASKSSGYFDMRTLLNNTLMKDQPTLAVTLVDNHDTEPGQSLQSWVEPWFKPLAYAFILTRQEGYPCVFYGDYYGIPKYNIPALKSKLDPLLIARRDYAYGTQHDYIDSADIIGWTREGVAEKANSGLAALITDGPGGSKWMYVGKQHAGKTFYDLTGNRSDTVTINADGWGEFKVNGGSVSIWVPKISTTSQITFTVNNATTVWGQNVYVVGNISQLGN

SEQ ID NO: 432 - DNA, 1752 bp, Unknown
  Obtained from an environmental sample
atgtccgaaagaggcgtcaggagagccgtgcgcaccgccctggtcgggttggcggcggccgccaccgccgcggtgacgctcggcgctcccaccgcccaggccgcgccggccgggaacaaggacgtcaccgccgtcctgttctcctggaacttcaactccatcgcccgcgagtgcaccgagcgactcggccccgcgggctacggcttcgtgcaggtctcgccgccccaggagcacatccagggctccgcgtggtggacccagtaccagcccgtgagttacaacatctccggccggctcggcaacgagcagcagttccgctcgatggtcaacacctgtaacaacgcgggtgtcggcgtcatcgtggacgcggtcatcaaccacatgtccgccggctcgggcaccggtaccggcggcacctcctactccaagtacaactaccccggcctctacagcggcaacgacttcggttcctgccgcgaggacatccggggcggtgactacaccaacgaccgctggcgggtccagaactgcgagctggtcggcctcgccgacctggacaccggcagcgcctacgtccagcagcagatcgccggctacatgaaccgtctgctgggctggggcgtcgccggtttccgggtggacgccgtcaagcacatcccggcccggcacatggagcagatccgcgcccgggtcaacggcggcgacgtcttctggaaccaggaggtcatctacggcgccggcgaggcgatcacgcccgaggagtacctcaacaccggtcacgtgcaggagttccgctacgcgttcgacctcaagcggatgttccagggcgaccggatcgccaatctgcagaacttcggcgagtcatggggctacatgccctccaaccgctccggcgtcttcgtcgacaaccacgacaccgagcgcaacggctccaccctcagctacaaggacaacgccgcctacaccctggccaacgtcttcatgctggcctggccctacggcagcccggacgtgcactccggctacgagttcaccaacttcgacgccggtccgcccaacaacggcaacgtgaccgcctgccaccagagcgggtggaagtgccagcacgcctggcaggagatctcctccatggtgggcttccgcaacgccacccgcggccaggccgtcaccaactggtggtccaacggcaacaacgccatcgccttcggccggggcaaccgcggctacgtggcgatcaaccacgagaacaccacactgaaccggaccttccagacctccctgccggccggtgactactgcaacgtgcagaacggcaccaccgtcaccgtcaacggcgccgggcagttcaccgcgagcctcggcgcccgcaccgccctcgccctgcacgtcgacgcccgcaattgcgccggcggcggcaccgggggcaacggcggcaccgggggaggcgagaacccggtgaccggcggtgcctccttcggcgtcgacgcgaccacgcagatgggccagaacatccacgtcgcgggcaacatccccgcgctgggcgactggaacaccgccaacgccccccgcatgagcgccgacacctacccggtctggcggctggaactgaacctgccgcccggcaccaccttccagtacaagtacatccgcagggacgccaacggcaacgtgacctgggaatccgggaacaaccgcaccgccaccgtgccctcctccggccgggtgacgctcaacgacacctggcgcaactga

SEQ ID NO: 433 - protein, 583 aa, Unknown
  Obtained from an environmental sample
  SIGNAL (1)...(34)
MSERGVRRAVRTALVGLAAAATAAVTLGAPTAQAAPAGNKDVTAVLFSWNFNSIARECTERLGPAGYGFVQVSPPQEHIQGSAWWTQYQPVSYNISGRLGNEQQFRSMVNTCNNAGVGVIVDAVINHMSAGSGTGTGGTSYSKYNYPGLYSGNDFGSCREDIRGGDYTNDRWRVQNCELVGLADLDTGSAYVQQQIAGYMNRLLGWGVAGFRVDAVKHIPARHMEQIRARVNGGDVFWNQEVIYGAGEAITPEEYLNTGHVQEFRYAFDLKRMFQGDRIANLQNFGESWGYMPSNRSGVFVDNHDTERNGSTLSYKDNAAYTLANVFMLAWPYGSPDVHSGYEFTNFDAGPPNNGNVTACHQSGWKCQHAWQEISSMVGFRNATRGQAVTNWWSNGNNAIAFGRGNRGYVAINHENTTLNRTFQTSLPAGDYCNVQNGTTVTVNGAGQFTASLGARTALALHVDARNCAGGGTGGNGGTGGGENPVTGGASFGVDATTQMGQNIHVAGNIPALGDWNTANAPRMSADTYPVWRLELNLPPGTTFQYKYIRRDANGNVTWESGNNRTATVPSSGRVTLNDTWRN

SEQ ID NO: 434 - DNA, 1302 bp, Unknown
  Obtained from an environmental sample
atgagcaatatgtataaacgcaactcaatgtttttatttatagttctttttgttttgttatcttttgtgccagcagtggcagacccaccccaggaagtatcagaaggcgttatgcttcagggttttggctggaacagtcaagttagaggttcgccctctaaatggtacactcttattgaaagtaaagcagacagcatcaaaaatctaggcgttgattttgtgtggttcccgcctgtagctcgttctgtaagccctcagggatacctccctggtgactactatgatttaggcagtgacgattaccctacattttatggcaccaaagatcagctaaaggcagctttaaaagctctaaacgacagaaacattgcacctgttgccgacattgtagttaatcatagatgtgctggcaagcaagatgagaacggcatctggaatatattccactatccttcgggcaaggcacaatgggaacaatgggcggtctgtgaaggtcagtttggtggaacaggcaatcctgacacaggagataattttcatgctgcacctgacattgaccacacaaacaagcaggtccaacaagacataagcgattggatgaactggctaaaagagctgggctttagagcttggcgctacgactattctagaggttatgctgctaaatatgcgggtctttatgacaaaaacacacaacctttgttctctgttggcgaactttggacgaatatggctttcgaaggctcctggctcaagccaaatcaagatgctcacaggcaattacttgttgactggcttgacgagaatcctagtccagttgccacaatatttgactttaccaccaaagggattttacaggtagccgtacacggagaataccaaagacttattgactcaaacaataatgctccaggccttattggatggtggcctcaaagagcagtaacatttattgacaatcacgacactggctctcagcaaagtcattggccatttgcagacgacaaagttatgcagggttatgcatacatcttaacacaccccgggattccctgcctattctgggagcacgtttacgactggaatttgtatgatcaaatcaagcaactagttgatattcgcaagcaaaataaaataaacagtacaagctcgctaaaaatcttaagagccgagacgggcctctacgcagcaattattgatgacaaggttgttttaaaacttggttggcaagattggtatcctggcgaaggctttgaactaaaagccagcggagagcagtatgctgtgtgggttaaaaactag

SEQ ID NO: 435 - protein, 433 aa, Unknown
  Obtained from an environmental sample
  SIGNAL (1)...(27)
MSNMYKRNSMFLFIVLFVLLSFVPAVADPPQEVSEGVMLQGFGWNSQVRGSPSKWYTLIESKADSIKNLGVDFVWFPPVARSVSPQGYLPGDYYDLGSDDYPTFYGTKDQLKAALKALNDRNIAPVADIVVNHRCAGKQDENGIWNIFHYPSGKAQWEQWAVCEGQFGGTGNPDTGDNFHAAPDIDHTNKQVQQDISDWMNWLKELGFRAWRYDYSRGYAAKYAGLYDKNTQPLFSVGELWTNMAFEGSWLKPNQDAHRQLLVDWLDENPSPVATIFDFTTKGILQVAVHGEYQRLIDSNNNAPGLIGWWPQRAVTFIDNHDTGSQQSHWPFADDKVMQGYAYILTHPGIPCLFWEHVYDWNLYDQIKQLVDIRKQNKINSTSSLKILRAETGLYAAIIDDKVVLKLGWQDWYPGEGFELKASGEQYAVWVKN

SEQ ID NO: 436 - DNA, 1311 bp, Artificial Sequence
  Synthetically generated
atggccaagtactccgagctggaaaagggcggggtcataatgcaggcgttctactgggacgtgccttcaggaggaatatggtgggacacaatacggcagaagataccggagtggtacgatgccggaatctccgcaatatggattcccccggcgagcaagggcatgggcggcgcctattcgatgggctacgacccctacgacttctttgacctcggtgagtacgaccagaagggaacggtagagacgcgctttggctccaagcaggagctcgtgaacatgataaacaccgcccacgcctatggcatgaaggtaatagccgatatagtcatcaaccaccgcgccggcggtgacctggagtggaaccccttcgtgaacgactatacctggaccgacttctcaaaggtcgcgtcgggtaaatacacggccaactacctcgacttccacccgaacgagctccatgcgggcgattccggaacatttggaggctatcccgacatatgccacgacaagagctgggaccagtactggctctgggccagccaggagagctacgcggcatatctcaggagcatcggcatcgatgcctggcgcttcgactacgtcaagggctatgctccctgggtcgtcaaggactggctgaactggtggggaggctgggcggttggagagtactgggacaccaacgtcgacgctgttctcaactgggcatactcgagcggtgccaaggtctttgacttcgccctctactacaagatggatgaggcctttgacaacaaaaacattccagcgctcgtctctgcccttcagaacggccagactgttgtctcccgcgacccgttcaaggccgtaacctttgtagcaaaccacgacaccgatataatctggaacaagtatccagcctacgcgttcatcctcacctacgagggccagccgacaatattctaccgcgactacgaggagtggctcaacaaggataagctcaagaacctcatctggatacatgagaacctcgccggaggaagcaccgacatagtctactacgataacgatgaactcatcttcgtcaggaacggctacggggacaagccggggcttataacctacatcaacctaggctcgagcaaggccggaaggtgggtttatgtgccgaagttcgcgggcgcgtgcatccacgagtatactggtaacctcggaggctgggtagacaagtacgtctactcaagcggctgggtctatctcgaagctccagcttacgaccctgccaacgggcagtatggctactccgtgtggagctactgcggggtgggctga

SEQ ID NO: 437 - protein, 436 aa, Artificial Sequence
  Synthetically generated
MAKYSELEKGGVIMQAFYWDVPSGGIWWDTIRQKIPEWYDAGISAIWIPPASKGMGGAYSMGYDPYDFFDLGEYDQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASQESYAAYLRSIGIDAWRFDYVKGYAPWVVKDWLNWWGGWAVGEYWDTNVDAVLNWAYSSGAKVFDFALYYKMDEAFDNKNIPALVSALQNGQTVVSRDPFKAVTFVANHDTDIIWNKYPAYAFILTYEGQPTIFYRDYEEWLNKDKLKNLIWIHENLAGGSTDIVYYDNDELIFVRNGYGDKPGLITYINLGSSKAGRWVYVPKFAGACIHEYTGNLGGWVDKYVYSSGWVYLEAPAYDPANGQYGYSVWSYCGVG

SEQ ID NO: 438 - DNA, 1539 bp, Unknown
  Obtained from an environmental sample
atgaaatttaagcgcgctgcgggaatcatccttcatcctaccagcttgccggggccggatggaattggtgaccttggaccggaagcataccgctggatcaactttctagccgaatccggctgcaaactatggcaggtgctgccgcttggcccaaccggttacggcgactcgccctatcagtgtttctcagcatttgccggtaatccctatctggtcagcccggcgctgttgctggaaaacggtttgttacggcggagtgatctgaccgaccgccctgaatttaatccaattcgaattgattacggtgaagccatcacttggaaattaaaaatactcgatcgcgcttacgaaaactttaagcgcctcaataatcctgaactaaaatatgaatatcagcaattcacggaaaatgagacggactggttgaatgattttgccctttttatggccattaaggaggctaacgggggggtatcctgggacaactggccaaaggaactgcgtagccgccagccggacgcaatcgaaaagttcaaacaaaccgaagccgaccgcattcaacgccatgcctttcgacagtttttattcttccgccagtggcttgacctgaaagcctacgccaatcaaaagaacatccaaatcatcggtgatataccgatttttgtcgcttacgatagcgcagatgcttggtcgaacccagagttgttttatctgaatgaagaaggcaaaccaactgttgtggcaggcgttccaccggattatttttccccaacgggtcaattatggggtaacccgctttacaagtgggaagttcatcgtcagcagaatttccgctggtggattcgccggatgcaagccacattacggctggtagatattgtccgcctcgaccattttcgcggatttgccggttattgggaagtaccctttgggatgcccaccgccgaaattggccgctgggtaaaggggcccggcaaagaattattcaatgccattcgggatgcccttggcgatttacccatcatcgctgaagatttgggggtcatcacccccgatgtgattgaactgcgcgattcgtttaacttgcccggtatgaaggtgttccagtttgcttttacaacggacccgctcgatcccttcctgccgcacaactacgaaaccaattgtgtagcctacactggtacccacgacaacgacaccgccttgggttggtatcaaagcgcaccggaaaaagaacgtgactttattcgccgatatctcgcccgttccggcgaagatatatcatgggacatgatccgcgctgtgtggtcttcagtggccgtttttgcgcttgcgcccatgcaagatattttgagccttggaaatgaagcccgcatgaatctaccgggaagagccagcggcaactggtgttggagattacaccccgaggctttcaacccggtaatattaaaacggctcaaagaagtcaactacttgtacgcgcgcaccgacattgagcgcaccgtacagaccgaaatacccccgaactatcccttataa

SEQ ID NO: 439 - protein, 496 aa, Unknown
  Obtained from an environmental sample
  DOMAIN (11)...(493): 4-alpha-glucanotransferase
MKFKRAAGIILHPTSLPGPDGIGDLGPEAYRWINFLAESGCKLWQVLPLGPTGYGDSPYQCFSAFAGNPYLVSPALLLENGLLRRSDLTDRPEFNPIRIDYGEAITWKLKILDRAYENFKRLNNPELKYEYQQFTENETDWLNDFALFMAIKEANGGVSWDNWPKELRSRQPDAIEKFKQTEADRIQRHAFRQFLFFRQWLDLKAYANQKNIQIIGDIPIFVAYDSADAWSNPELFYLNEEGKPTVVAGVPPDYFSPTGQLWGNPLYKWEVHRQQNFRWWIRRMQATLRLVDIVRLDHFRGFAGYWEVPFGMPTAEIGRWVKGPGKELFNAIRDALGDLPIIAEDLGVITPDVIELRDSFNLPGMKVFQFAFTTDPLDPFLPHNYETNCVAYTGTHDNDTALGWYQSAPEKERDFIRRYLARSGEDISWDMIRAVWSSVAVFALAPMQDILSLGNEARMNLPGRASGNWCWRLHPEAFNPVILKRLKEVNYLYART

SEQ ID NO: 440 - DNA, 3447 bp, Unknown
  Obtained from an environmental sample
atgaatcaaatagttaatttcaaatcgcatttctatagaaaaatagcccttttattttcaatcacttttatatgggcggcaggctcgctgtctgcacaggattttatgatgcagggctggtactgggattatcctaaagtggactgcaatcagtatcagggcccgtctcttgcatcagagatggctgctcttgccgaggagcaaagtgaggccggtttcacgatgatgtggcttccgccattgtcgaaagcaagttttggaaactgcagcaatggatacgatccccgggatctgtatgattatggccaggctaccggccggaccgggcttggcacaggtacagaagtagaaacctggatgacatcactcagcgagaacgatatttatccgatagcggatgtggtttataatcaccgggacgggggtgaatgggaggataaccctgcagtgcgcgattacatcataaactatccaaataacctatcctgcgacggcatgccggcaacaccctacccggtaaacggcaaagcgaggtatgtactgcctttgggcggagacagcggcaataacgaaggggattacttttttaaatttgcatctgcttcgggcgaaaccggttttaatggggcagaatataaactgtttttccgcaccagggataccgggtttattgatgatccgatttttgaatcagaaaataatggcggcgctgactgcgatcaggataatgatcaaatatttttaggcagagatatttttgcatcacaggaagtgggcggaagctgtaatacggatgaattttatcttgaattaaattcgggagactttgatgctgacggagatatgcttgagatttatatagaggaggttggtggcggtggtaccggaattgatcagcgtatttatggaatttggtcggccagcagaagtgaagacatacatgatgatttaatcgtgcaaacccggactgattttacaaacatgccaagcgggaaaggggcaatgacattccgccatttcaagccaaacggcataacaccaacctgtatgacgggtgataaagattttcctttctttttctttgatattgaacaggagtatgatggaaacgaaggcggcgagtcaacccgcaaggttttcgacgactggaaccaatggttatgggataccctgggcatcagaggatttcgcctggatgcggtaaaacatttcccggcatggtttgtgggagtactgctgaatgatttgcatgccgcaggcaaaaatccccccatggtagtaggtgaacattttacgctggatgcctccgttttgagagactggatagacagggtttacgatgcaatgacgccgggggcagcagaagcgatccaggtaagagcctttgattttgaattgagagacaggcttaaacaagccgccgataacccaagttatgatacgcgaaatatatttaacagcgggcttgtagacggagtgggtatgagcggtgcgcactcggtcacgtttctgaataaccatgattacaggacgccgggtgagcatatcatcagaaatcaaatgctggcatatgcttatatccttaccaataaccgcattggcctgcccagtatttttcaccccgattattatggcatcgatatttatggccaggatcatccgatcgaaaaacaacaggaagcgatagatgaactaatgcaaatacacagggattttattaccggagctgaatttgttgattacctgaatcgttttgatacgccatatgataacgcgtatcagcaatccggcccatggaatcatttgctctatcaaattcagggtggcgttggtgagaaggatgtgatagtgctcataaattttggtgatgaacaattgcggtttaaccatactattaatacagcgaatgctccacttggtacaacattttctttggtagctggagaatcgaattttcctaatccagaggtggaggttagcccaaataatattgaaaactctctttttttcgatataccggcgaactcttatgcggtttatgtacaaagtgatgcagtggaactgacaggtgaagagggcttccgtatgctgtctgtgcctgttccaacaacttattcggcgtttcttgatcctatttggacacagggagctgatgaaggtgccaacgtatccggcggagatccaaatgtatttacctgggataatacatcagagaacggcagttccgaaaactggagcggactcaacgatttgacgggtaaaatagaagccggcaccgggttcctggtttatgtatataagaatgatgagtttggtgttgaaggtatctttcccaaaactctgagagtaagcggccccgcgcatggcgatacatcccctgagatgaatcagaatgacggcggattcaccctgcttggaaaccctttttccactacgatcgactttaatcaattggacaaaaatggcttaaccgatgtggcttatgtgtgggacccgaatgcaggttcctggcggtcatgggatgcagacggaaatgccggggatttggccaacgggttgattgctcctttccagggcttctttgtacagtcaggttcaggaagcccatccgtcacatttaatgatcaaaccaaaagctccggtggcgtattctacggaaaagaaaaagatgaacaacgcagcatcgtccgccttgagctgagtggtgaagagcttcaaaactctgcctggctgcgctttagtgaatccggttcatatgaatcacaggttcgcggcgatgcactgcaactggagccgctgagccaaacttttgcgaagctcgccatcgaaaagggcggcacactgtttgatatcagccaccttccggtaatggatgaagagtacagtgttccggtacacatcagcgcaactaacagcggggtttatacactaactgcaaccgattttgaactgcctggtaaccttgagctgactttccacgatcacgcggccggaacttccgttccgctgaatgcagatttcagttacaccattgagcaggcacaggcggctaaagctgctgaactgagcccgctggagcgtgtgaagcagggcccggttgtagcaaaagtaactgcggattcaccgcagtacagcattacggtcaatagttcggcagatattggtggtacggatgagttgcctgaacgcgtagccctccgccagaactatccaaacccatttaacccggttaccgtaatcacatacgagctgcctgaaaacagcaatgtaaccctggaagttttcgacatggccggccgtaaagtatctacactggtaaacgaaaaggtaagcgcagggtcacacgatgttgcgttcgatgcctctcacctttcaagcggtgtatacatctaccggctgcatgccggcgagcatatgctgacgcggaaactgactttaataaagtga

SEQ ID NO: 441 - protein, 1148 aa, Unknown
  Obtained from an environmental sample
  SIGNAL (1)...(32)
  DOMAIN (34)...(569): Alpha amylase, catalytic domain
MNQIVNFKSHFYRKIALLFSITFIWAAGSLSAQDFMMQGWYWDYPKVDCNQYQGPSLASEMAALAEEQSEAGFTMMWLPPLSKASFGNCSNGYDPRDLYDYGQATGRTGLGTGTEVETWMTSLSENDIYPIADVVYNHRDGGEWEDNPAVRDYIINYPNNLSCDGMPATPYPVNGKARYVLPLGGDSGNNEGDYFFKFASASGETGFNGAEYKLFFRTRDTGFIDDPIFESENNGGADCDQDNDQIFLGRDIFASQEVGGSCNTDEFYLELNSGDFDADGDMLEIYIEEVGGGGTGIDQRIYGIWSASRSEDIHDDLIVQTRTDFTNMPSGKGAMTFRHFKPNGITPTCMTGDKDFPFFFFDIEQEYDGNEGGESTRKVFDDWNQWLWDTLGIRGFRLDAVKHFPAWFVGVLLNDLHAAGKNPPMVVGEHFTLDASVLRDWIDRVYDAMTPGAAEAIQVRAFDFELRDRLKQAADNPSYDTRNIFNSGLVDGVGMSGAHSVTFLNNHDYRTPGEHIIRNQMLAYAYILTNNRIGLPSIFHPDYYGIDIYGQDHPIEKQQEAIDELMQIHRDFITGAEFVDYLNRFDTPYDNAYQQSGPWNHLLYQIQGGVGEKDVIVLINFGDEQLRFNHTINTANAPLGTTFSLVAGESNFPNPEVEVSPNNIENSLFFDIPANSYAVYVQSDAVELTGEEGFRMLSVPVPTTYSAFLDPIWTQGADEGANVSGGDPNVFTWDNTSENGSSENWSGLNDLTGKIEAGTGFLVYVYKNDEFGVEGIFPKTLRVSGPAHGDTSPEMNQNDGGFTLLGNPFSTTIDFNQLDKNGLTDVAYVWDPNAGSWRSWDADGNAGDLANGLIAPFQGFFVQSGSGSPSVTFNDQTKSSGGVFYGKEKDEQRSIVRLELSGEELQNSAWLRFSESGSYESQVRGDALQLEPLSQTFAKLAIEKGGTLFDISHLPVMDEEYSVPVHISATNSGVYTLTATDFELPGNLELTFHDHAAGTSVPLNADFSYTIEQAQAAKAAELSPLERVKQGPVVAKVTADSPQYSITVNSSADIGGTDELPERVALRQNYPNPFNPVTVITYELPENSNVTLEVFDMAGRKVSTLVNEKVSAGSHDVAFDASHLSSGVYIYRLHAGEHMLTRKLTLIK

SEQ ID NO: 442 - DNA, 1668 bp, Unknown
  Obtained from an environmental sample
atgaaccgatacctgcgactggccgcgctgaccctggccctggcgccgctggcctacccctggggcaacctggtgcgcgccgccgacgcgccgggcaagaccgccagcggcgtgcgctatcacggcggcgacgagatcatcctccagggctttcactggaataccgtgcggacctcgagcaactggtacgcgacgttggccagcatggcgccgaccctggccgccgatggcttcagtgcgatctggatgccggtgccctggcgcgacttctccagctggagcgaccccggcaacggcacctcgggcggtggcgaaggctacttctggcacgacttcaacaagaacggccgctatggcagcgacagcctgctcagacaggccgccggcgcgctcaatgcggccggggtcaaacccatctacgacgtggtgcccaaccacatgaaccgcggctacccggacaaggaaatcaacctgccggccggccaggggctgtggcgccacgactgcactgacccgggcaattacgccaacgactgcgacgacggcgaccgtttcatgggcggcgacgccgacctcaataccggccacccgcagaactacgcgatgttccgcgacgagttcgccaggctgcgcagcgagtatggcgccgggggctttcgcttcgacttcgtccgcggctacgccggcgagcgggtcgccagctggatgagcgatgcccacgacaacggcttctgcctcggcgagctgtggaaggcgccgggcgagtacccgagctgggactggcgcaacggcgccagctggcagcagatcctcaaggactggtccgatcgcgccaagtgcacggtgttcgacttcgccctcaaggagcgcatgcagaacggtggcatcgccgactggcgccacggcctcaacggcaaccccgatgcgcgctggcgcgaggtggcggtgaccttcgtcgacaaccacgacaccggctactcgcccggcccgcacggcggccagcaccactggccgctgccggatgcgcggctgaagcaggcctatgcctacatcctcagcagcccgggtacgccggtggtgtactggccacacatgtacgactggggtcatggcgacttcatccgccagttgatccagatccgccgtgcggccggagtcaaggcggcctcggcgatccagttccactcggggttctccggcctggtggcgaccatcagcggcagccagcagcaactgctgatcgccctggactccaacctgtcctcgcccggccaggtggccagcggcgatttcacccaggcgctcaacaccgacaacggcgcgatccgtatctggcgcagcggtcagggcggcggggatgagccgggcaacctggtcagcgtcaacttccgttgcgacaacggcgtgacccagtggggcgacagcgtctacgcgctgggcaacgtcgcccagctgggcaactggagcccggccggcgccgtgcgcctgaccgacaccagcgcctatccaacctggaagggcagcattgccctgccggccggtcagcaggtgcagtggaagtgcatcgtgcgcagcgaaagcaacccgacccaggtcaagacctggcagccgggcggcaacaacagcgtgacggtggcggcaggagccagtaccgcggggagtttctag

SEQ ID NO: 443 - protein, 555 aa, Unknown
  Obtained from an environmental sample
  SIGNAL (1)...(27)
  DOMAIN (45)...(395): Alpha amylase, catalytic domain
  DOMAIN (458)...(554): Starch binding domain
MNRYLRLAALTLALAPLAYPWGNLVRAADAPGKTASGVRYHGGDEIILQGFHWNTVRTSSNWYATLASMAPTLAADGFSAIWMPVPWRDFSSWSDPGNGTSGGGEGYFWHDFNKNGRYGSDSLLRQAAGALNAAGVKPIYDVVPNHMNRGYPDKEINLPAGQGLWRHDCTDPGNYANDCDDGDRFMGGDADLNTGHPQNYAMFRDEFARLRSEYGAGGFRFDFVRGYAGERVASWMSDAHDNGFCLGELWKAPGEYPSWDWRNGASWQQILKDWSDRAKCTVFDFALKERMQNGGIADWRHGLNGNPDARWREVAVTFVDNHDTGYSPGPHGGQHHWPLPDARLKQAYAYILSSPGTPVVYWPHMYDWGHGDFIRQLIQIRRAAGVKAASAIQFHSGFSGLVATISGSQQQLLIALDSNLSSPGQVASGDFTQALNTDNGAIRIWRSGQGGGDEPGNLVSVNFRCDNGVTQWGDSVYALGNVAQLGNWSPAGAVRLTDTSAYPTWKGSIALPAGQQVQWKCIVRSESNPTQVKTWQPGGNNSVTVAAGASTAGSF

SEQ ID NO: 444 - DNA, 1521 bp, Unknown
  Obtained from an environmental sample
atgacaccgtttggccagcccatgatgccgggcgcccggatggcagccgccaatatggccccggtgcgtgccgcttcggccctgaccgatgtcagcagtgcccggcgcacctggcatgatgagatcatctattttatttttaccgatcgctttgagaacggtgatcgcagcaatgattaccgggtcaagcccaatgacccctgggcctatcatggcggtgaccttcagggcattatcaatcgactggactatatacagaatctgggagccaccgctctctggatcaccccggtgattgataaccgggatggcccctttgtggcagattttggcaatggccgcaaacaggaaatctggggttaccacggctactggtttaaagacttttataaagtcgaggagcatctgggtgatatggccaagctgcgcgagctggttcagaaagcccaccagcgtggcatcaaggtgctgctggatattgtggtcaatcacacggattatgatcatccctttgccctgcaggcccaggagcctggtaataaataccacagctggtttaatcagcatggtgatatccgtgactggaatgacccctggtgggttgagaacggccgcctggctggcctgcctgacctgaaccagggcaatcctgaaaccgcccgttatctgattgatgccatgaagttctggatcaaagaaaccggcgtggatggcttccgcattgatacggtcaagcacgtaccccgcactttctggcagcagtttaaccgtgaaattcgccagtttgccggcgacgactttttgctgctgggtgagatttttaccggtcaccccgaagtgcaggtgccctatctgcgtgaaggcatgcataccgcctttgactttccgctgtactatgccatcaaagatgcctggggtcagagtcgcagcatgcgcagtctgggggcaatttttgccaaagaccatctttaccccgacgccaatttgctttcgccctttattgataaccatgacgtgccgcgctttgtacatgaagccaatggtcgccagcgcgatcgcctgatggctgctctgggctttatctttgcgattcgcggcatgccaagtctttactacggtactgaagtggccctgcccggtggtggggatcccgacaaccgccgtgatatgcagtttaaccgggaccctgagctgcaggcttatgtcaagcgccttgctgagatgcgcaagcagcagccggccctgcgccgtggccgccagctggagatgtggcaggacgatcaggtgtatgccttttcacgcctgacccctcaggccaacgaagaggtgctggccttttttaacaacagctttcaaccccagcagcgccggattgccttgcgggatgaaagccccaataaagggcgtaacccccgtctggtcaatctcctgaacgcgcaggataccctgcaggtacaggatggcgcggtgaatatcaccgtgccacccatgggctatctgttttaccgtccggccaactga

SEQ ID NO: 445 - protein, 506 aa, Unknown
  Obtained from an environmental sample
  SIGNAL (1)...(24)
  DOMAIN (45)...(409): Alpha amylase, catalytic domain
MTPFGQPMMPGARMAAANMAPVRAASALTDVSSARRTWHDEIIYFIFTDRFENGDRSNDYRVKPNDPWAYHGGDLQGIINRLDYIQNLGATALWITPVIDNRDGPFVADFGNGRKQEIWGYHGYWFKDFYKVEEHLGDMAKLRELVQKAHQRGIKVLLDIVVNHTDYDHPFALQAQEPGNKYHSWFNQHGDIRDWNDPWWVENGRLAGLPDLNQGNPETARYLIDAMKFWIKETGVDGFRIDTVKHVPRTFWQQFNREIRQFAGDDFLLLGEIFTGHPEVQVPYLREGMHTAFDFPLYYAIKDAWGQSRSMRSLGAIFAKDHLYPDANLLSPFIDNHDVPRFVHEANGRQRDRLMAALGFIFAIRGMPSLYYGTEVALPGGGDPDNRRDMQFNRDPELQAYVKRLAEMRKQQPALRRGRQLEMWQDDQVYAFSRLTPQANEEVLAFFNNSFQPQQRRIALRDESPNKGRNPRLVNLLNAQDTLQVQDGAVNITVPPMGYLFYRPAN

SEQ ID NO: 446 - DNA, 3537 bp, Unknown
  Obtained from an environmental sample
gtggcctgggacacgctcccttcgcgcgccgacgaccagccgggcttccagttcacaccatcgcccgcggactggcgcacgatcagcatgtaccagatcatgacggaccggtttaacgatggcgacccgtcgaataacaccgccaatggcgtctacgacccggtcaacccgagtgcgattcacggcggcgactttgtgggcatccggcagaagctggattacatccaggaactcggcatcagcgccatctggatttcaccggtgcagttctccgtgaatgcctaccacgcctatgccccgaccgatttcaaccggatcgaaacccacttcggcagcctgcaagaactccgggaactcattgacgactgccacgcccgcggcatttacgtgatcatcgatatcgtcatcaaccacatggccgacttgatcggttccagcgaccccgggttcccggccttcaactggaatggatacaatttgaggtggtgggacccgaaccgtcgccatgcgccgccgttcgacgacctgagccgattccataatttcggggaaatcgacaattacgacgatccctggcaggtgctctatggcgagttcaagccgggcggactcgatgatatacggaccgaagacccgcaggtgcgccaggacttgatccgcattttcaaggcgctgatcgacgccaccgacgcggatggcttccgcgtggacgccgtgaagcatgtggaggagggtttcttcgccgagttcatgccggccatctacgcgcacgccgcctaccgcggcaaagagaacttcctgatcttcggggaatcgattgacgggaacgacgtgaccctctcgcggtggacccacccgaattatcacttcaactccatgctcaatttcccgatgtattacaagatgatggacgtcttcgtgcatcggcagcggacgagtctgctcacggagcggatcaatgatctctggcgatacagcgaagggtcgcgcctgcaactcgtgaacttcctggataaccacgacacatggcggattatgtacgatcagaacctggatggggacatctggcgaatccgccccgcactgacctttctctatacctcgctccagattccctgcctctactacggcaccgaacaggccttcaacggcggaaccgatccatggaatcgcgagaacatgttcgacggcggtttccagtggggcccctcggcaggggatcgcttcgacaccacacatccgctctaccagttcatccgcaagctgaaccagttgcggcgggactatcccgctttgacgctggggaatttcgtgcagcgctggcaaacttcgtcggggccgggcatctatgcctactcgaagattctcggcgaccaggaattgctggtggtgctgaatacaagcgcgtcggtgcagaactgcacgcctgcggtttcgcggccgaacggtaccgtgtttgtgaacctgctcaatccatccgagcaggtcaccgtctccggtggtacgctggcggtcagcgtgctggggcacgaccagaagatcttcgccgagccgcgcccgccgctctggctgggcaacgtgagcacctggcccggccccacccataaccagtgtccgggcgagttgtgcaaccccacgctggaacccgatgaggagttgtgggtcgacgccgagacccggccgatacggcccggacaaaccgtgaccgtctattatcgcaccgcggccgccgcgacgtggaccgcccgcgaaatgctctggcgcgaaaacacggcgcagggatcgctctggcatgtgaatctgggcgggttccccgcgggcgtgacgatcgagtattacgtgcgcgccaccgacggcgatgaagttcaatatgccaacaacggcgggtcgaacagcttcatttccgtcgtctatgaagcagtgccctcctccttatccgtcgcgccatggcccagcatcggctgcgagccggtcaccttgttgtataaacccaacgatggtccgctcgccggcgcctccgcgatctatgcgcatctcggacgcaacggctggaacgatatcgtcacgcccgcgcccgcgctggaatacgtggccgggctggatgcgtggcgcctggtcgtcacgccgagtcccggcacgttgcagctcgatgtcgtcttccatgatggggccggcgtctgggacaacaacgatttcgagaactggttcgtccccgtgcaggattgcgatgaagagccgggcgtcttcctggtcacgtatccggccgagtcgccttaccttgcagagtcttcagttgcatcaatcgatttcgagggcgtcgccgacgggcttgccgggcaactggtttggagtaacgcgctcacgggagcaacgggcgttcagccgctggcacccgtctggcgcattgacgccatcggcctcgccgagggccataacccgattaccctctgggccctgcatgacgccgggccttccgttacgcaggcggtggaccgcgccttgcactacgcggcaggcggctggtccgacggcggcgacctcggcggcggctggggcggtggctggtttctgcagtccttcggcaccgccggtcattttcttgccgatgcaggggtgaacgggaatctgaggctcggagatcatgcatgggggctctggtcacaaaccgatgcccttgccgaggcggtgcgccccttcgcgcatccgctgagcgtgggccaacgtttcgaggtgcgcctccagaacaactggttgctcgaagggcagcagggggtcggcgtggcgctgcgcgacggcgatggtgcatcgcgcgtccagttctacttcaacgggggcgacgagcaatacagcgttgccgatcgcgacggcgcccgccccagtggcatacactggacggatgagccacttcccctttcgatcgaagttctgtcggccggcgtctaccgtcttacggtcaacggcgtcgaagtggacggtcacttcgagggcgacctgagtgaagtgcgcgtctggagttataatggaggactgacccccgactatgacttcttcttcgatgacatccgaatcgtcgctcccactttcaccgcaacggatcgcgtcgatcgcgttgtgatccggtcgcagagcggaactggcgacagcaacggagatggaatccccgatgcatggtatctgcggtatggctttaatcccttcggaccttcgattgcgcatctggacagcgacggtgacggttcttccaacggggaggagtttgtggccgacacgaatccgaacgatccttcttcctacttcccgaagacgatcgaggcgaatatgcagggcgccaccataaccttcacgctgggtccgccgacctcgccggaccgcgagtacgagattctgcattgtccggatatggtgacgggaatctggacaccgatgaatctacgtcgatccggccgcgccgaccggggtgcaatgcagatcacagtgacgaaccagggcccgcagggcgcctaccgcacccgcgtctcattgccgacggagccataa

SEQ ID NO: 447 - protein, 1178 aa, Unknown
  Obtained from an environmental sample
  DOMAIN (32)...(426): Alpha amylase, catalytic domain
MAWDTLPSRADDQPGFQFTPSPADWRTISMYQIMTDRFNDGDPSNNTANGVYDPVNPSAIHGGDFVGIRQKLDYIQELGISAIWISPVQFSVNAYHAYAPTDFNRIETHFGSLQELRELIDDCHARGIYVIIDIVINHMADLIGSSDPGFPAFNWNGYNLRWWDPNRRHAPPFDDLSRFHNFGEIDNYDDPWQVLYGEFKPGGLDDIRTEDPQVRQDLIRIFKALIDATDADGFRVDAVKHVEEGFFAEFMPAIYAHAAYRGKENFLIFGESIDGNDVTLSRWTHPNYHFNSMLNFPMYYKMMDVFVHRQRTSLLTERINDLWRYSEGSRLQLVNFLDNHDTWRIMYDQNLDGDIWRIRPALTFLYTSLQIPCLYYGTEQAFNGGTDPWNRENMFDGGFQWGPSAGDRFDTTHPLYQFIRKLNQLRRDYPALTLGNFVQRWQTSSGPGIYAYSKILGDQELLVVLNTSASVQNCTPAVSRPNGTVFVNLLNPSEQVTVSGGTLAVSVLGHDQKIFAEPRPPLWLGNVSTWPGPTHNQCPGELCNPTLEPDEELWVDAETRPIRPGQTVTVYYRTAAAATWTAREMLWRENTAQGSLWHVNLGGFPAGVTIEYYVRATDGDEVQYANNGGSNSFISVVYEAVPSSLSVAPWPSIGCEPVTLLYKPNDGPLAGASAIYAHLGRNGWNDIVTPAPALEYVAGLDAWRLVVTPSPGTLQLDVVFHDGAGVWDNNDFENWFVPVQDCDEEPGVFLVTYPAESPYLAESSVASIDFEGVADGLAGQLVWSNALTGATGVQPLAPVWRIDAIGLAEGHNPITLWALHDAGPSVTQAVDRALHYAAGGWSDGGDLGGGWGGGWFLQSFGTAGHFLADAGVNGNLRLGDHAWGLWSQTDALAEAVRPFAHPLSVGQRFEVRLQNNWLLEGQQGVGVALRDGDGASRVQFYFNGGDEQYSVADRDGARPSGIHWTDEPLPLSIEVLSAGVYRLTVNGVEVDGHFEGDLSEVRVWSYNGGLTPDYDFFFDDIRIVAPTFTATDRVDRVVIRSQSGTGDSNGDGIPDAWYLRYGFNPFGPSIAHLDSDGDGSSNGEEFVADTNPNDPSSYFPKTIEANMQGATITFTLGPPTSPDREYEILHCPDMVTGIWTPMNLRRSGRADRGAMQITVTNQGPQGAYRTRVSLPTEP

SEQ ID NO: 448 - DNA, 1575 bp, Unknown
  Obtained from an environmental sample
atgagattaattatgaaaaaaatgatcatcctaattacgctcgcttgggtttttaccggctgcgagagctcaaagtttaaagaagagagcaactatacctcaagctactctgccgaatggccaatggcgacgagctatgagatttttgttcgctcatttgctgatagcaatggtgacggtattggagatataaaaggaatgacagaaaagttaccttatttgcaagacctgggaattaaaggagtatggttaatgccgattcatccctcaccttcttaccataaatatgatgtgacggactataaaggcgtgcatgaagactatggtaccctagaggatttcaaaaagtttgtaaagcgagcgcatgagcatgatattaaagtagtgatagattttgtgatcaatcatacagcgagggagcacccttggtttcaagagtcgatgaaggggcctgataatccttatcgcgactactatgtgtgggcgaaaaaggaggatatagaagatgaaatcaataaaaaggaaacggcattagactctgacaatatcgagcagtggcatgaggcacccggcaatgaggagctatactacggctacttttggggtggtatgccagatttgaattttgacaatcctgaagtgaagcgtgaaatatttgatgcgggaaggttttggttggaagaagttggtgtggatggctttcgattggatgctgcaagacatatttttccagacgatcgggcagctgacaatcatgctttttgggtagaatttcgcaatgagatgaaaagagtaaaccctgatgtttatctagttggtgaagtatgggctgatatggaaacagtagcaccttatttgagtggtttgcccgcacttttcaattttgatatgagctataaaatcgtggaggcggtgcagcgtcaggccaatgaagaaatagcggagtatcatgcaaaggtgatgaactattatcaagggatcaaccctaattatattgatgccaccttcattaccaatcacgatcagccacggagcatgagtcagtttgagggggatgtgaataaagggaagctagctgcttcactactatttacactgcctggcgcaccttatttgtactatggtgaagaaattgggatgttggggccaaagcctgatcctgaaatcagagagccgtttttatggaaagaaggtgagaaggatgtttaccgcacgagttggatagaggcgaaaaactctaatgacgaaacagtaattccagccaaagtacagaaagaagatccggaaagcttattgaaccactacaagagatgggtggctctcagacataaaagtgaggcgcttagcgaaggccgaatcgtgcctgtagccacagataatcaacaaatggctgtttgggagcgagtaagtaaaaatgaaagggtactcgtgattcataatctttcagatagtcctcaaactatatcagaggaggtaagccgtaaatatgatttggctaataaaaagatgatatggggaagtgtacaaaacaatgagctaagtcctagagggtctttagtctttgtgattaactaa

SEQ ID NO: 449 - protein, 524 aa, Unknown
  Obtained from an environmental sample
  DOMAIN (47)...(442): Alpha amylase, catalytic domain
  SIGNAL (1)...(23)
MRLIMKKMIILITLAWVFTGCESSKFKEESNYTSSYSAEWPMATSYEIFVRSFADSNGDGIGDIKGMTEKLPYLQDLGIKGVWLMPIHPSPSYHKYDVTDYKGVHEDYGTLEDFKKFVKRAHEHDIKVVIDFVINHTAREHPWFQESMKGPDNPYRDYYVWAKKEDIEDEINKKETALDSDNIEQWHEAPGNEELYYGYFWGGMPDLNFDNPEVKREIFDAGRFWLEEVGVDGFRLDAARHIFPDDRAADNHAFWVEFRNEMKRVNPDVYLVGEVWADMETVAPYLSGLPALFNFDMSYKIVEAVQRQANEEIAEYHAKVMNYYQGINPNYIDATFITNHDQPRSMSQFEGDVNKGKLAASLLFTLPGAPYLYYGEEIGMLGPKPDPEIREPFLWKEGEKDVYRTSWIEAKNSNDETVIPAKVQKEDPESLLNHYKRWVALRHKSEALSEGRIVPVATDNQQMAVWERVSKNERVLVIHNLSDSPQTISEEVSRKYDLANKKMIWGSVQNNELSPRGSLVFVIN

SEQ ID NO: 450 - DNA, 1890 bp, Unknown
  Obtained from an environmental sample
atgaatgattcaatcaatctttataacttcttcccgtacaatagaccaatgtcaatcaataaaacaaacactatgaaacaaatgatcaactggctaggtagtctcgcgctactcatgttgctattgagttgtggtgaggctactgagtcctcatccctcgccaatcaaaaaggagaaaaagagcgctcagatgaaggctctgatgataagaaagtaatttatcaagtgtttacacgaacatttggtaatcagaattctactaacaagatgcacggtactgttgaggaaaatggcacgggtaagttcaatgacttcactctagacgcactcgaaggcatcaaggagcttggcgtaactcacatttggtatacaggagtgattgctcatgctaccgccacagatttcagtgagtatggggtagcagtggataatccgagagtgatcaaggggcgagcgggtagtccttatgctatcaaggattactatgacgtaaacccggatctagcggaagatgtagataagcgaatggatgaattcgaagatatggtcaagcgtacgcatgagcgtgggatgaaggtgatcatagactttgtgcctaatcacgtagcgcgttcctaccaaggtcagcagcagcctgagggtatcaccgctttgggcgctgaggatgatactagcaaagcatttgatgtaaataatcacttttactacttaccgggtcaggattttcaagtgccggcaggctatcgtccgctggggctttctgccaaggagatggaagacttacctgcttatgaggagtcacctgctaaggcaacgggcaatgatgtatttagtgcaagtccatcagtgaatgactggtttgagacgatcaagttgaactatggtgtggattaccaaaatggtggtaagcagcatttttcagctactcagatccctgatacttgggagcgcatgaaggagatcttactcttttgggcaggtaagggcgtggatggctttcgttgtgatatggctgagatggtgccggtggagttttgggaatgggtgagtgcggcattgaaagaagagtatcctgatatcctattaattgcagagatttacaatcccgatgcttataagccttacatcaaacaaggaggcttcgattatttatatgacaaagtacaaacctacgacagcctgcgcaatgtgatgcaagatagaggtactacgcggggtatttcggcatcattggaagccttggtagatgtggagccacatatgttgcgatttctcgaaaaccatgatgagcagcgaatagcctcttcatttttcgcgggggatgcttttgccggtcttcctgcactggccattagcaacttggctagtggtagtcccttcatgctttattttggtcaggaagttggggaacccgccactgaagctgctggctttagtgaggcggacggtagaagtacaatttttgactacttcggtatacctgagcatcagaagtggatgaatgaaggtgcctttgatggtggacagctttcagaagatcagcagcggcttagagcattgtaccaagagattatccgagtatctacactcagtcgattggcaaactcagagccttttacttgcagattagaccaagtggagtcctcatcccccgaaaaaatacattgcttttctagagaaaatgaggaagaagagtggtatgtggtcaccaacttttctgatcaatcgactgaggtgagtgtgaaagacctaagtgcagacaaggctcagatgatgttttactggagaaaagagcttagcgagctgcctgaggaaattgaaatagaggatggaaagttaaagtgggaattagacccttatgccatcttggtgttttctttggctaagtaa

SEQ ID NO: 451 - protein, 629 aa, Unknown
  Obtained from an environmental sample
  DOMAIN (75)...(496): Alpha amylase, catalytic domain
  SIGNAL (1)...(49)
MNDSINLYNFFPYNRPMSINKTNTMKQMINWLGSLALLMLLLSCGEATESSSLANQKGEKERSDEGSDDKKVIYQVFTRTFGNQNSTNKMHGTVEENGTGKFNDFTLDALEGIKELGVTHIWYTGVIAHATATDFSEYGVAVDNPRVIKGRAGSPYAIKDYYDVNPDLAEDVDKRMDEFEDMVKRTHERGMKVIIDFVPNHVARSYQGQQQPEGITALGAEDDTSKAFDVNNHFYYLPGQDFQVPAGYRPLGLSAKEMEDLPAYEESPAKATGNDVFSASPSVNDWFETIKLNYGVDYQNGGKQHFSATQIPDTWERMKEILLFWAGKGVDGFRCDMAEMVPVEFWEWVSAALKEEYPDILLIAEIYNPDAYKPYIKQGGFDYLYDKVQTYDSLRNVMQDRGTTRGISASLEALVDVEPHMLRFLENHDEQRIASSFFAGDAFAGLPALAISNLASGSPFMLYFGQEVGEPATEAAGFSEADGRSTIFDYFGIPEHQKWMNEGAFDGGQLSEDQQRLRALYQEIIRVSTLSRLANSEPFTCRLDQVESSSPEKIHCFSRENEEEEWYVVTNFSDQSTEVSVKDLSADKAQMMFYWRKELSELPEEIEIEDGKLKWELDPYAILVFSLAK

SEQ ID NO: 452 - DNA, 1734 bp, Unknown
  Obtained from an environmental sample
gtgatgcaactgaatccctggttttctaccacgcttaaggccgctggcctggcgaccgctctggctgcggtcagcgcttgccagccggcatccgagtcggcttatcaagccccaactgcagcgcctgtcgagcagaccgaagcgccctggtgggacgatgcggttttctaccaaatctggccgcgtagtttttacgataccagcggtgatggccatggcgattttaatggcatgaccgccaaactgccttatttgtctgagctaggcattgatgccatctggctaacgccgatgtttgaggcgccgtcttatcatggctatgactttaccgagttttatcaggtggaatcggactatggcaccatggccgacttcgagcgctttttgcaacaagctgaagagcgcggtatccgggtgattctggatctggtgatcaaccacatttcccgtgagcaccagtggtttaagcagtcagcccagcgcattgagccgtacagcgattactttatctggcgggaaagcctgccagaagccggcaagggctggggccatgcctggtcggataacgatatgcccgaagcggtctggcattttgatgagacccggggcgagtactactacgccgcctttggtgccacccagccggatctgaatctggagcacccggatgtgatcgaagaaatgaaacggatggctaaattctggctggataaaggggtcgatggcttccggctcgatgcggtgcgctttgtgatagagcgcggcccgaaaggccaggccgacttgcccgagaccattgattactggaaagacttcaacgcctttgtcaaaagcgttaaccccgaagcctacttagtgggcgaagcctgggttgatattccggtggcagccaaatactggggtgaaggcaaagggctggatcagggctttgattttgagtttggttacatcgtgctggatatgctgcagcaagggctggccacggaagcccagtttggcaccatgagccagcagtccggtcaggctgaagatggcgctttgcatccactggcgcagaatgtgcagcgccgcctggagtcgggcgcaccgctggccttcttcacgccctttttaaccaatcacgatcaggacagagttggctttcaattgctggaaagtcaggccaaagccaaacaagcggcggcgctgttatttagctcgccgggcaccaagtacatctactacggtgaagaaattggcatgacccagctaaaaagtggccatgatgtttacaagcgggcgccaatgttgtgggatcaagggcatcaggccggctttacccaggcagaaaaggcttgggtagagcaaaaagatttattcagccgccattttgatgcctggtggccggatttcctgacgcagcagttggcagtcggcgatcggacagtggaagcacaacgtgcacagccggactccttgtggaacttgcaccgtctgctgatcgagctgcaaaagcagcggccggaaatgcgtttggctggctcgtaccaggtgcaatcgccacagcagggtattctgtcggtgacgcgtgagctgggcgagcaaagcacggtgtttgtgctgaatctggctggtgaaatggctgatattgctgctgtgctggcagcgcacagcaatctgtcagtaagttggggctttgatttggatggtaatttgttggctatagatggtttgttgattttgcaaagtcagtag

SEQ ID NO: 453 - protein, 577 aa, Unknown
  Obtained from an environmental sample
  DOMAIN (58)...(440): Alpha amylase, catalytic domain
  SIGNAL (1)...(34)
MMQLNPWFSTTLKAAGLATALAAVSACQPASESAYQAPTAAPVEQTEAPWWDDAVFYQIWPRSFYDTSGDGHGDFNGMTAKLPYLSELGIDAIWLTPMFEAPSYHGYDFTEFYQVESDYGTMADFERFLQQAEERGIRVILDLVINHISREHQWFKQSAQRIEPYSDYFIWRESLPEAGKGWGHAWSDNDMPEAVWHFDETRGEYYYAAFGATQPDLNLEHPDVIEEMKRMAKFWLDKGVDGFRLDAVRFVIERGPKGQADLPETIDYWKDFNAFVKSVNPEAYLVGEAWVDIPVAAKYWGEGKGLDQGFDFEFGYIVLDMLQQGLATEAQFGTMSQQSGQAEDGALHPLAQNVQRRLESGAPLAFFTPFLTNHDQDRVGFQLLESQAKAKQAAALLFSSPGTKYIYYGEEIGMTQLKSGHDVYKRAPMLWDQGHQAGFTQAEKAWVEQKDLFSRHFDAWWPDFLTQQLAVGDRTVEAQRAQPDSLWNLHRLLIELQKQRPEMRLAGSYQVQSPQQGILSVTRELGEQSTVFVLNLAGEMADIAAVLAAHSNLSVSWGFDLDGNLLAIDGLLILQSQ

SEQ ID NO: 454 - DNA, 1341 bp, Unknown
  Obtained from an environmental sample
ttggatctgttagaatataagaatacaattcaacggagacaaacgatgactgaccgcaagttgttatttatagttgcgaccgtgatactggcagttctggtgtcgttttcggcagagctcgaagcaagagtcaagcctaccaatgctgttatgctccagggattcggctggaactctcagtcccgaggcaccccaagcaaatggtacaatttgattggcgacagggccaaagacatagccgatctaggtgtaacgatggtctggtttccgccggtgagtcgctctgtgagtcctcagggctatcttccgggcgactggtatgatctcggaacagagaaggacccgacgttttacggccataaggatagccttttgtacgctttaagcgagctgaaaaagcacggtatttctccgatcgccgacatagtcataaaccacaggtgcgccagccatcaggacaagaacgggatttggaacatctaccattttccgtcaggaaaggcgcgctgggagcaatgggcgatctgccgcggccagtttggtggacagggaaaccctgacacaggcgagagctaccatgcggctccagacgttgatcatacgaacgtcagggttcagcgggatataatcgagtggatgaactggctgaaatctcttggctttgaaggttggcgttatgactactcaaaaggctaccatccaaggtatactgccctttatgaccggtctaccaggcccgtattgtctgtaggtgagatatggacaaacatgtctttcaacggctcttatcttaacccaaatcaggacgcccaccgacagcagctctgcgactggcttgacggggccggcaactatgccaccgcctttgacttcactacgaaggggattcttcaggtagccgttaaaggtgagtactggcgactacgcgacaaggacggcaaggcgtcgggattaataggctggtggcccgaacgcgcagtcacatttgtcgataatcacgataccggttcccagcaaagccactggccatttcccggcaacaaggttatgcaggggtacgcatatattcttacacatccaggcataccctgcattttctgggagcatgtctacgactggaaactacgtgaaccgatcaaaaggcttgtccagatcaggaagaaatatggattgcacagcaagagcagtcttaagatcgttagagccgagcagaatctttatgctgcgatcattgacggaaaggtagccttgaagcttggcagcgctgactggtcaccgccaggcaatgattttgaacttctcacacatggcgaccagtttgcagtttggggcagaaaataa

SEQ ID NO: 455 - protein, 446 aa, Unknown
  Obtained from an environmental sample
  SIGNAL (1)...(37)
  DOMAIN (49)...(386): Alpha amylase, catalytic domain
MDLLEYKNTIQRRQTMTDRKLLFIVATVILAVLVSFSAELEARVKPTNAVMLQGFGWNSQSRGTPSKWYNLIGDRAKDIADLGVTMVWFPPVSRSVSPQGYLPGDWYDLGTEKDPTFYGHKDSLLYALSELKKHGISPIADIVINHRCASHQDKNGIWNIYHFPSGKARWEQWAICRGQFGGQGNPDTGESYHAAPDVDHTNVRVQRDIIEWMNWLKSLGFEGWRYDYSKGYHPRYTALYDRSTRPVLSVGEIWTNMSFNGSYLNPNQDAHRQQLCDWLDGAGNYATAFDFTTKGILQVAVKGEYWRLRDKDGKASGLIGWWPERAVTFVDNHDTGSQQSHWPFPGNKVMQGYAYILTHPGIPCIFWEHVYDWKLREPIKRLVQIRKKYGLHSKSSLKIVRAEQNLYAAIIDGKVALKLGSADWSPPGNDFELLTHGDQFAVWGRK

SEQ ID NO: 456 - DNA, 1734 bp, Unknown
  Obtained from an environmental sample
gtgatgcaactgaatccctggttttctgcctctttaaaagccgcaggccttgcgaccgctctggcagcggtcagcgcttgccagccggcacccgagtcgggttatcaagccccaacggcagcgcctgtcgagcagaccgaagcgccctggtgggacgatgcggttttctaccaaatctggccgcgtagtttttacgataccagcggtgatggtcatggcgactttaatggcatgaccgccaaactgccttatttgtcggagcttggcattgatgccatctggctgacgccaatgtttgaggcgccgtcttatcatggctatgactttaccgagttttatcaggtggaatcggactatggcaccatggccgacttcgagcgctttttgcaacaggctgaagagcgcggtatccgggtgattctggatttggtgatcaaccacatttcccgtgaacaccagtggtttcagcgctccgccgagcgcattgagccgtacagcgattactttatctggcgggaaagcctgccagaaaccggcaaaggctggggtcatgcctggtcagataacgatatgcctgaagcggtctggcattttgatgagacccggggcgagtactactacgccgcctttggtgccacccagccggatctgaatttggagcacccggatgtgatcgaagaaatgaaacggatggccaagttctggctggataagggggtcgatggcttccggctcgatgcggtgcgctttgtgatagagcgaggcccgaaaggccaggccgacttgcccgagaccattgattactggaaagacttcaatgcctttgtcaaaagcgtcaatccagaagcctacttagtgggcgaagcctgggtcgatattccggtggcggcgaaatactggggggaaggcaaagggctggatcagggctttgattttgaatttggctacatcgtgctggatatgctgcagcaaggcttggccacagaagcccagtttggcaccatgagccagcagtccggtcaggcggaagacggcgccttgcatccgctggcgcagaatgtgcagcgccgcttggagtcgggcgcaccgctggccttcttcacgccctttttaaccaatcacgatcaggacagagttggctttcaattgctggaaaaccaggccaaagccaaacaagcggcggcactgttattcagctcgccgggcagcaagtacatctactacggtgaagaaattggcatgactcagctcaaaagtggccatgatgtctacaagcgggcgccgatgttgtgggatcaagggcatcaggccggctttacccaggcagaaaaggcctgggtggagcaaaaagatttattcagccgccattttgatgcctggtggccggatttcctgacacagcagctggcagtcggcgatcggacagtggcagcacagcgcgctcaaccggactccttgtggaacttgcaccgtctgctgatcgcgatgcaaaagcagcggccggaaatgcgtttggcgggctcgtatcaggtgcaatcgccacagcagggtattttgacggtggtgcgggagctggataacagccgctcggtctttgtactgaatctggctggtgaaacggccgatatcgcatcggtgatggctgcctatggcgagctgtcggtcacttggggctttgacctggacggcagcttgctggcgaccgatggtctggtcatcttgcaatcgcggtaa

SEQ ID NO: 457 - protein, 577 aa, Unknown
  Obtained from an environmental sample
  SIGNAL (1)...(26)
  DOMAIN (58)...(440): Alpha amylase, catalytic domain
MMQLNPWFSASLKAAGLATALAAVSACQPAPESGYQAPTAAPVEQTEAPWWDDAVFYQIWPRSFYDTSGDGHGDFNGMTAKLPYLSELGIDAIWLTPMFEAPSYHGYDFTEFYQVESDYGTMADFERFLQQAEERGIRVILDLVINHISREHQWFQRSAERIEPYSDYFIWRESLPETGKGWGHAWSDNDMPEAVWHFDETRGEYYYAAFGATQPDLNLEHPDVIEEMKRMAKFWLDKGVDGFRLDAVRFVIERGPKGQADLPETIDYWKDFNAFVKSVNPEAYLVGEAWVDIPVAAKYWGEGKGLDQGFDFEFGYIVLDMLQQGLATEAQFGTMSQQSGQAEDGALHPLAQNVQRRLESGAPLAFFTPFLTNHDQDRVGFQLLENQAKAKQAAALLFSSPGSKYIYYGEEIGMTQLKSGHDVYKRAPMLWDQGHQAGFTQAEKAWVEQKDLFSRHFDAWWPDFLTQQLAVGDRTVAAQRAQPDSLWNLHRLLIAMQKQRPEMRLAGSYQVQSPQQGILTVVRELDNSRSVFVLNLAGETADIASVMAAYGELSVTWGFDLDGSLLATDGLVILQSR

SEQ ID NO: 458 - DNA, 1698 bp, Unknown
  Obtained from an environmental sample
atgttcaaggtcagtttaaggagtaaagacatgaagaagttaagtttaatagttaccattttggtgcttgctttgaccttatcagcgtgtcaaagagagaccgaagaagaagttggcgaaacctatgactttttgagtttgtttccgaatcatcgaaactattatcaaatactcgttcgtagctttgccgacggcaatggcgatggcatcggtgattttattggcttaaaagaagcccttccacatcttgccgatttagggattgaaggcttatggctgttgccgattcatccttcaccaagttaccacgggtatgacgtgacagactttagagcgatcaatccggattatggtacgatggaagattttgaagcgtttattgcagaagcacagcgtttgaacattgacgtcgtgatcgattatgtcatcaatcattcttccaatcaacacccttggtttcaaaatttcaaacagggtatcgccccttacgatcaattttatcgtcgtattgataacactgatcccagatggaacacgcgtggttcttggggtcaaagcatctggcactcactgggggatggaaccgcttatgtgggctattttggcgggtacatgcctgatttgaactggtcgaatgacgctttagttgaagaaatgatcgacatcggtcttttctggcttgaaaaaggcgtgagtgggttccgtttagatgcggccttgcatttgttagccaataacgaagtgccgtcaagcaccccagcgttagaagaaaccttatttatgctagagtattttgagtttcgtttaaaagagaaatttcctgatactttcattgtgggtgaaatttgggatgcttttagtatttacaacatgttttaccgtagtatggactcagtttttcactttgactttggtcacttggtcgtgaacacgattaacactggttctaatcgcaactatgctgatcaaatcgtccgctggcacaatcaagcgcaagcagtagacgatgtggttatcgaagcgccgtttttaagaaatcatgatcaaaaccgtctggcttcagcctcctctccaggctcaccgaatctcggccccaacgcccatcctgataaactgcgtttagccgcagagatgttattgactgtccctggaagtccgtttatttattatggtgaagaactcggcatgaaaggggaagcctctggtcgagccccaacgtgggattcaacgattcgtttaccttacttgtgggacgacgaacgtcaaccaacgtggacgtttgaccggtttgggtttgtcgatacgtttaatgtcgatgtcccgaccttgccagaacaacaagccgatccgttatcactctttaacacataccgtaccttactacatttaagacaagcgcatcctgccttaagactcggtactattgaagcgtttgaagaaaatcatgcgggcttacaagggttttaccgtatttttgaatacagcaccttccaagaagtggtcttagtgcttcataacgtgagtgatgagactttgaacgtgactcgtttacctgaaggtgagatgatttacctaagtgcacatcttgaagattttccagcgctcgaacaactcaatcagacgcttgatatcggccctagaagtacgctcatgattcgtttaagtgagacagcgatggagcgtttcttcaatgaatga

SEQ ID NO: 459 - protein, 565 aa, Unknown
  Obtained from an environmental sample
  DOMAIN (56)...(464): Alpha amylase, catalytic domain
  SIGNAL (1)...(29)
MFKVSLRSKDMKKLSLIVTILVLALTLSACQRETEEEVGETYDFLSLFPNHRNYYQILVRSFADGNGDGIGDFIGLKEALPHLADLGIEGLWLLPIHPSPSYHGYDVTDFRAINPDYGTMEDFEAFIAEAQRLNIDVVIDYVINHSSNQHPWFQNFKQGIAPYDQFYRRIDNTDPRWNTRGSWGQSIWHSLGDGTAYVGYFGGYMPDLNWSNDALVEEMIDIGLFWLEKGVSGFRLDAALHLLANNEVPSSTPALEETLFMLEYFEFRLKEKFPDTFIVGEIWDAFSIYNMFYRSMDSVFHFDFGHLVVNTINTGSNRNYADQIVRWHNQAQAVDDVVIEAPFLRNHDQNRLASASSPGSPNLGPNAHPDKLRLAAEMLLTVPGSPFIYYGEELGMKGEASGRAPTWDSTIRLPYLWDDERQPTWTFDRFGFVDTFNVDVPTLPEQQADPLSLFNTYRTLLHLRQAHPALRLGTIEAFEENHAGLQGFYRIFEYSTFQEVVLVLHNVSDETLNVTRLPEGEMIYLSAHLEDFPALEQLNQTLDIGPRSTLMIRLSETAMERFFNE

SEQ ID NO: 460 - DNA, 1752 bp, Cochliobolus heterostrophus ATCC 48331
  CDS (1)...(1752): Exon
atgccacaagatttacgaccttggtggcaaactgccatcggttatcaaatatggccggcgtctttcaaagattcgaacagtgatggcataggcgatctcaatggagttctcagcaagctcgactacctccgatcactggaagtcgatctcatctggttttctcctgtctatgattcgcccaacagagacatgggatatgatgtctctgattacgaatccattcacccacagtatggcaccattgccgacatggaaaacctcatcaaagaggccaagaaacgtaacatcaaaattgtcatggatatggtcacaaatcattcgtctgaccaacaccgctggttcttggagagttgcaaatctcggtcagggccatatagtgacttttacatctggcgggatccaaaatacgatagcgaaggtaaccgacaaccaccaaataattggcgcactgggtcacgatatggaaaaagtacatggaagtacgtcgaagcaagagatcagtactatttctgctttggaactacttatcagcctaacttgaattggttctgcgacgatttgagacgcgcaatatacgacagcgcggtgaaattttggttggacagaggtgtcgatgggttcaggatggatttggtcgggttatactggaaagatccaacctttcctgatgcaaaagaagtttatcctggagaggcgctgcaaccgcttgacggatcgcggtgtttgaatggcgaagaagtgcatgtctggttaaaggagttgaaggaaagaatcacgcaagactttggacaggacatcgtgttgattggggagctcccctcgactgaccgggagacattcctacgatacatatctcctgaatcgagagaactagagatggctctcgatacagacatcttcatcgtgggaaatgaatggacagatggtctgtacgagctcaaaaagccagagctaccgctattcaaagatgccgtcctgaagacgcagagccttcttgacgatggaggctggcctactgcattcctcgagaatcatgatttcgctcgcagtgtatcccgttttgggccaggtgaggggacctatcgcgaagctgccgcaaggatgcttgctctcatggctgcaacactttccggaacctttttcatctaccagggtcaagaaattggaatgaccaacgtcccatcacattggaggcgagatgacttcaaagataacgccgacctcgaacacatcgaagatattgatccaatcaaagacgctgaggcggtggagaaatccgttgatgcgcttaccacatgggggcgagataatggaagaacgccagtccagtggtcagacaaagatcatgccgggtttagcgacgtgaaaccctggattagggtcatcgacaactacacttacataaacgtcgaagagcaacttggaaacccgaacagcatacgttctttctgggtaaagatgatgaagatgaggaaagagatgtatgatgtgttagcctgcgggcattttcgtctcgttgacagggacaacctcagtgtgttctcgtatacgaaaacaagtgctgatggaaagaccgagatgctagtggtattgaacttttcgagcgaggaggctcgggctccgaggcaaatcgggaaagatctaatgcatctcgtttgcacgacagctgcgatgtcgacgaagactagcttagatgaagtcacattgcagccatgggagggtcgcttgtatcgactggcaccaaagttgtag

SEQ ID NO: 461 - protein, 583 aa, Cochliobolus heterostrophus ATCC 48331
  DOMAIN (16)...(421)
MPQDLRPWWQTAIGYQIWPASFKDSNSDGIGDLNGVLSKLDYLRSLEVDLIWFSPVYDSPNRDMGYDVSDYESIHPQYGTIADMENLIKEAKKRNIKIVMDMVTNHSSDQHRWFLESCKSRSGPYSDFYIWRDPKYDSEGNRQPPNNWRTGSRYGKSTWKYVEARDQYYFCFGTTYQPNLNWFCDDLRRAIYDSAVKFWLDRGVDGFRMDLVGLYWKDPTFPDAKEVYPGEALQPLDGSRCLNGEEVHVWLKELKERITQDFGQDIVLIGELPSTDRETFLRYISPESRELEMALDTDIFIVGNEWTDGLYELKKPELPLFKDAVLKTQSLLDDGGWPTAFLENHDFARSVSRFGPGEGTYREAAARMLALMAATLSGTFFIYQGQEIGMTNVPSHWRRDDFKDNADLEHIEDIDPIKDAEAVEKSVDALTTWGRDNGRTPVQWSDKDHAGFSDVKPWIRVIDNYTYINVEEQLGNPNSIRSFWVKMMKMRKEMYDVLACGHFRLVDRDNLSVFSYTKTSADGKTEMLVVLNFSSEEARAPRQIGKDLMHLVCTTAAMSTKTSLDEVTLQPWEGRLYRLAPKL

SEQ ID NO: 462 - DNA, 1252 bp, Fungi
  CDS (1)...(114): Exon
  CDS (161)...(1252): Exon
atgtcaagatcttctaccattctttttgtgttggcagcagccaatttggcgtctctagtagatgctcatggctacatgaacataccctccagtcgaacaagcatcggccattcagtaagattccataaatccatttctattaccacattaacaattgaaggttggcatcgacacatgtcccgaatgtactattcttgagcccgtctcttcatggcctgatctcgacgtcgctccagttggacgcagcggtccttgcggctacaatgctcgggtcagcgtcgactacaattacccttccacaaactggggtaacacccccgtcaccacctatacagctggtcaaacagtcgatgtacagtggtgcgtagacaacaacggagaccatggcggtatgttcagctggcgcatctgtcaagaccaatccatcgtggataagctcatcacacccggatacatccccacggatgccgagaaacaagccgctgaggattgtttcgacgccggattactcccctgtaccgacgtcaccggagccacgtgcgattacaacgcagattgcactcccggacaagcctgttaccgaaacgactggtttacttgcaagggattcaacagcggcacaagatgtcaaggagtggatggcgccgctctcggctcttgctacacttccatcgcaggtggatatacagtgaccaagaaagtcaagatcccaaactacgcatcaaatcacaccctcatatccctgaaatggaattccttccaaacaggccaaatctatctaacctgcgccgatatcgccattgtcggttccggcagcggcggcggctcctcaagtaccacgagcaaaacatcttccacctccaccaccctcagcacatcgaccaaatcgagcaccaccaccagcgccaccacggcaaccacaagctgcgcctcaaccccttctctgattcccgtaaccttcaacgagctcgtcaccaccacctacggacaaaccatcaaagtcgccggctcggtcgccgctctcggaaactgggatgtttccgccgccgtcgcattgtcagctgtaaactacacgagtgcgaatccattgtggaccggaaccgtcatgttgccccccggacaggtggtgcagtataagtatgtgaatgtggcgagtagtgggacgccaacgtgggaaaaagatcccaatcgcgtttttacggtgcccgcgggttgtgcgacaaaggggaccgtgggggatacttggagatag

SEQ ID NO: 463 - protein, 38 aa, Fungi
MSRSSTILFVLAAANLASLVDAHGYMNIPSSRTSIGHS

SEQ ID NO: 464 - protein, 363 aa, Fungi
VGIDTCPECTILEPVSSWPDLDVAPVGRSGPCGYNARVSVDYNYPSTNWGNTPVTTYTAGQTVDVQWCVDNNGDHGGMFSWRICQDQSIVDKLITPGYIPTDAEKQAAEDCFDAGLLPCTDVTGATCDYNADCTPGQACYRNDWFTCKGFNSGTRCQGVDGAALGSCYTSIAGGYTVTKKVKIPNYASNHTLISLKWNSFQTGQIYLTCADIAIVGSGSGGGSSSTTSKTSSTSTTLSTSTKSSTTTSATTATTSCASTPSLIPVTFNELVTTTYGQTIKVAGSVAALGNWDVSAAVALSAVNYTSANPLWTGTVMLPPGQVVQYKYVNVASSGTPTWEKDPNRVFTVPAGCATKGTVGDTWR

SEQ ID NO: 465 - DNA, 1206 bp, Fungi
atgtcaagatcttctaccattctttttgtgttggcagcagccaatttggcgtctctagtagatgctcatggctacatgaacataccctccagtcgaacaagcatcggccattcagttggcatcgacacatgtcccgaatgtactattcttgagcccgtctcttcatggcctgatctcgacgtcgctccagttggacgcagcggtccttgcggctacaatgctcgggtcagcgtcgactacaattacccttccacaaactggggtaacacccccgtcaccacctatacagctggtcaaacagtcgatgtacagtggtgcgtagacaacaacggagaccatggcggtatgttcagctggcgcatctgtcaagaccaatccatcgtggataagctcatcacacccggatacatccccacggatgccgagaaacaagccgctgaggattgtttcgacgccggattactcccctgtaccgacgtcaccggagccacgtgcgattacaacgcagattgcactcccggacaagcctgttaccgaaacgactggtttacttgcaagggattcaacagcggcacaagatgtcaaggagtggatggcgccgctctcggctcttgctacacttccatcgcaggtggatatacagtgaccaagaaagtcaagatcccaaactacgcatcaaatcacaccctcatatccctgaaatggaattccttccaaacaggccaaatctatctaacctgcgccgatatcgccattgtcggttccggcagcggcggcggctcctcaagtaccacgagcaaaacatcttccacctccaccaccctcagcacatcgaccaaatcgagcaccaccaccagcgccaccacggcaaccacaagctgcgcctcaaccccttctctgattcccgtaaccttcaacgagctcgtcaccaccacctacggacaaaccatcaaagtcgccggctcggtcgccgctctcggaaactgggatgtttccgccgccgtcgcattgtcagctgtaaactacacgagtgcgaatccattgtggaccggaaccgtcatgttgccccccggacaggtggtgcagtataagtatgtgaatgtggcgagtagtgggacgccaacgtgggaaaaagatcccaatcgcgtttttacggtgcccgcgggttgtgcgacaaaggggaccgtgggggatacttggagatag

SEQ ID NO: 466 - protein, 401 aa, Fungi
  SIGNAL (1)...(22)
  DOMAIN (300)...(396): Starch binding domain
MSRSSTILFVLAAANLASLVDAHGYMNIPSSRTSIGHSVGIDTCPECTILEPVSSWPDLDVAPVGRSGPCGYNARVSVDYNYPSTNWGNTPVTTYTAGQTVDVQWCVDNNGDHGGMFSWRICQDQSIVDKLITPGYIPTDAEKQAAEDCFDAGLLPCTDVTGATCDYNADCTPGQACYRNDWFTCKGFNSGTRCQGVDGAALGSCYTSIAGGYTVTKKVKIPNYASNHTLISLKWNSFQTGQIYLTCADIAIVGSGSGGGSSSTTSKTSSTSTTLSTSTKSSTTTSATTATTSCASTPSLIPVTFNELVTTTYGQTIKVAGSVAALGNWDVSAAVALSAVNYTSANPLWTGTVMLPPGQVVQYKYVNVASSGTPTWEKDPNRVFTVPAGCATKGTVGDTWR

SEQ ID NO: 467 - DNA, 2746 bp, Cochliobolus heterostrophus ATCC 48331
  CDS (1)...(301): Exon
  CDS (380)...(454): Exon
  CDS (554)...(643): Exon
  CDS (717)...(2235): Exon
  CDS (2311)...(2746): Exon
atgatgagacgagatgaaagcagtaacagtgaccgggacgcatgcagttgcaagacgctagcctgttccagcatagccaacctttttggcggcttccctccctccggatgtccaagcagcgacgatcttgccccaaagtcttcatccacaagacttgcatcgagctggcagacacgtccagggcaccatgttcttttttgcttctacacctacttgtctacaccacttccacaccgacagctgagttgtacgattcatggcagtccgcggcatggcagtttcgtgcaggctgacgtcactggtgctgaatgttgacaagcacggtctccactcacatctagaccattcacaacgcgcgggtctcattcttgatagccagcacagccgaaggagtcaacatacaaacctgctcagccatggacctatacagggtattcacccgctatgagccgtagtgggtataaaagtaaagaacatgagcgacaagtatggctctgtcgaattttccggtgggcttgaaaacttcgcttgaacattgatctccttggtccagctgaaccagtacgctgcctaccaatcatcgggaaatcgtacaaaacagcacacctcaagtctaaactgaccagcgcatccctgacgatgggttcagaaggtaggtcaagtccagtgattgtttctcttccgattggactactgcgatgctcaccactgaacagaacagaagccaacgcctgagaatagcacgctgttccagggcttcgagtggaatgtcccggatgatcacaaacactggaagcgtcttgctgaacagctcccaaagctcaaagcgatcggtatcactaacatttggctacctccgggttgtaaagccgcgaatccaaagggtgtgggctatgacatctatgacctatacgacctgggcgaatttgatcagaaaggcgccaaaggcacgaaatggggaacaaaggaagagctattggagctcagcaaggttgccaaggaacacaacgttggcctttactgggatgccgtgttgaatcacaaggcgggtgcagataggacagagaagtgccgggttgtggaagtggatgaaaacgaccgcacaaaggagatatccgatgcctacgaaatcgaggggtggctaggattcgacttcccagggcgcggcgagcagtattccaagatgaagtaccactgggagcacttttctggaaccgactacaaccaggccaacgagaagaaggccatctacaagatcctgggtgaaaacaagggctggtcgcaaagcgtggacacggaatccggcaacgctgattacatgatgttcgccgacattgactactcgcaccctgaagttcaagcggatgtcaagaattggggtgtctggataaccaaagaagtgggactcaagggattccgcctcgatgctgtgcagcacttcagctcaagatttagcaacgaatggatcaagaacctccgcgagcagtgcggagacgacatgttcatcgtgggcgagttctggtcgggcgatgtcaaggaaatgagtgaatggctcgacggcatgcagcacgaaatttgcctgtacgactcgcccttgcttaacaagtttggctcgttgtcgacgtgcgaatcggccgatctgaggacagtgtttgacgactcgctggtccggctgcggccgatggatgctgtgacggttgtcactaaccacgacacgcagcctggacaggtcatggagaccaagattgagggcttctttaagccgcttgcatatgcactgattctgctccgacaggaaggatacccatgcccgttctatggcgatctgtatggcctgtcggagccgcacgaaacgccggcgtcgtgcggtggcaagcttgcagaccttatcctggcgcgtaagctgtttgcatacggagcgcaggaagactacttggacgaggccaattgcattgggttcgtgcgtcgtgggacatgggacaaggtggcgggtcttgcatgtgtgatgagcaatgcggggccagggcagatcagaatggctgtgggcgagatgcacgccggggagaagtggagcgacgtgcttggatgggagcagggcgaggtagagattgacagcgaaggctacggagtgttcaggtgtcctggcaccagcgtcgcggtgtgggtgcgaagtgatgctgagggacgcgaccagttccccaccaactgggatgcggatgtgtatggccagggatcgtgtgcgtaatggttgcgatggagggtgtacggatggggtagttgaatcacggcgctggcggccgatgacgcaaggccgcccaccctcttcacttgtccaagtcaggcgtgtactgttgtgagtagcgatgggcattatatcactggaaaaagaagacatggcgtgatgcgctgtcgtcgccctctgccctgtcgccgcggctcgcaggctgttagctggtggaagatgcgcgaaagtgcgtggggcggccgacagggctgccgcgcagcacagccaatcacccgccgcacaacaatagccgttttggacgtttcgcggcctttctggcaagcgagtatgcgacatcccgcgaagcatgatcgacggcccatgccggcagaatgctccctccctctgtaccatgatgcacacgcacacgcacatgctcgcacgcgcgcccgcgacacggccaacatgcgaggccaacggccccgtcctgccgccggacatgaagccgcatgtgccatgtga

SEQ ID NO: 468 - protein, 100 aa, Cochliobolus heterostrophus ATCC 48331
MMRRDESSNSDRDACSCKTLACSSIANLFGGFPPSGCPSSDDLAPKSSSTRLASSWQTRPGHHVLFCFYTYLSTPLPHRQLSCTIHGSPRHGSFVQADVT

SEQ ID NO: 469 - protein, 25 aa, Cochliobolus heterostrophus ATCC 48331
AQPKESTYKPAQPWTYTGYSPAMSR

SEQ ID NO: 470 - protein, 30 aa, Cochliobolus heterostrophus ATCC 48331
TEPVRCLPIIGKSYKTAHLKSKLTSASLTM

SEQ ID NO: 471 - protein, 507 aa, Cochliobolus heterostrophus ATCC 48331
EQKPTPENSTLFQGFEWNVPDDHKHWKRLAEQLPKLKAIGITNIWLPPGCKAANPKGVGYDIYDLYDLGEFDQKGAKGTKWGTKEELLELSKVAKEHNVGLYWDAVLNHKAGADRTEKCRVVEVDENDRTKEISDAYEIEGWLGFDFPGRGEQYSKMKYHWEHFSGTDYNQANEKKAIYKILGENKGWSQSVDTESGNADYMMFADIDYSHPEVQADVKNWGVWITKEVGLKGFRLDAVQHFSSRFSNEWIKNLREQCGDDMFIVGEFWSGDVKEMSEWLDGMQHEICLYDSPLLNKFGSLSTCESADLRTVFDDSLVRLRPMDAVTVVTNHDTQPGQVMETKIEGFFKPLAYALILLRQEGYPCPFYGDLYGLSEPHETPASCGGKLADLILARKLFAYGAQEDYLDEANCIGFVRRGTWDKVAGLACVMSNAGPGQIRMAVGEMHAGEKWSDVLGWEQGEVEIDSEGYGVFRCPGTSVAVWVRSDAEGRDQFPTNWDADVYGQGS

SEQ ID NO: 472 - protein, 144 aa, Cochliobolus heterostrophus ATCC 48331
PPTLFTCPSQACTVVSSDGHYITGKRRHGVMRCRRPLPCRRGSQAVSWWKMRESAWGGRQGCRAAQPITRRTTIAVLDVSRPFWQASMRHPAKHDRRPMPAECSLPLYHDAHAHAHARTRARDTANMRGQRPRPAAGHEAACAM

SEQ ID NO: 473 - DNA, 2421 bp, Cochliobolus heterostrophus ATCC 48331
atgatgagacgagatgaaagcagtaacagtgaccgggacgcatgcagttgcaagacgctagcctgttccagcatagccaacctttttggcggcttccctccctccggatgtccaagcagcgacgatcttgccccaaagtcttcatccacaagacttgcatcgagctggcagacacgtccagggcaccatgttcttttttgcttctacacctacttgtctacaccacttccacaccgacagctgagttgtacgattcatggcagtccgcggcatggcagtttcgtgcaggctgacgtcactgcacagccgaaggagtcaacatacaaacctgctcagccatggacctatacagggtattcacccgctatgagccgtactgaaccagtacgctgcctaccaatcatcgggaaatcgtacaaaacagcacacctcaagtctaaactgaccagcgcatccctgacgatggaacagaagccaacgcctgagaatagcacgctgttccagggcttcgagtggaatgtcccggatgatcacaaacactggaagcgtcttgctgaacagctcccaaagctcaaagcgatcggtatcactaacatttggctacctccgggttgtaaagccgcgaatccaaagggtgtgggctatgacatctatgacctatacgacctgggcgaatttgatcagaaaggcgccaaaggcacgaaatggggaacaaaggaagagctattggagctcagcaaggttgccaaggaacacaacgttggcctttactgggatgccgtgttgaatcacaaggcgggtgcagataggacagagaagtgccgggttgtggaagtggatgaaaacgaccgcacaaaggagatatccgatgcctacgaaatcgaggggtggctaggattcgacttcccagggcgcggcgagcagtattccaagatgaagtaccactgggagcacttttctggaaccgactacaaccaggccaacgagaagaaggccatctacaagatcctgggtgaaaacaagggctggtcgcaaagcgtggacacggaatccggcaacgctgattacatgatgttcgccgacattgactactcgcaccctgaagttcaagcggatgtcaagaattggggtgtctggataaccaaagaagtgggactcaagggattccgcctcgatgctgtgcagcacttcagctcaagatttagcaacgaatggatcaagaacctccgcgagcagtgcggagacgacatgttcatcgtgggcgagttctggtcgggcgatgtcaaggaaatgagtgaatggctcgacggcatgcagcacgaaatttgcctgtacgactcgcccttgcttaacaagtttggctcgttgtcgacgtgcgaatcggccgatctgaggacagtgtttgacgactcgctggtccggctgcggccgatggatgctgtgacggttgtcactaaccacgacacgcagcctggacaggtcatggagaccaagattgagggcttctttaagccgcttgcatatgcactgattctgctccgacaggaaggatacccatgcccgttctatggcgatctgtatggcctgtcggagccgcacgaaacgccggcgtcgtgcggtggcaagcttgcagaccttatcctggcgcgtaagctgtttgcatacggagcgcaggaagactacttggacgaggccaattgcattgggttcgtgcgtcgtgggacatgggacaaggtggcgggtcttgcatgtgtgatgagcaatgcggggccagggcagatcagaatggctgtgggcgagatgcacgccggggagaagtggagcgacgtgcttggatgggagcagggcgaggtagagattgacagcgaaggctacggagtgttcaggtgtcctggcaccagcgtcgcggtgtgggtgcgaagtgatgctgagggacgcgaccagttccccaccaactgggatgcggatgtgtatggccagggatcgccgcccaccctcttcacttgtccaagtcaggcgtgtactgttgtgagtagcgatgggcattatatcactggaaaaagaagacatggcgtgatgcgctgtcgtcgccctctgccctgtcgccgcggctcgcaggctgttagctggtggaagatgcgcgaaagtgcgtggggcggccgacagggctgccgcgcagcacagccaatcacccgccgcacaacaatagccgttttggacgtttcgcggcctttctggcaagcgagtatgcgacatcccgcgaagcatgatcgacggcccatgccggcagaatgctccctccctctgtaccatgatgcacacgcacacgcacatgctcgcacgcgcgcccgcgacacggccaacatgcgaggccaacggccccgtcctgccgccggacatgaagccgcatgtgccatgtga

SEQ ID NO: 474 - protein, 806 aa, Cochliobolus heterostrophus ATCC 48331
  DOMAIN (164)...(550): Alpha amylase, catalytic domain
MMRRDESSNSDRDACSCKTLACSSIANLFGGFPPSGCPSSDDLAPKSSSTRLASSWQTRPGHHVLFCFYTYLSTPLPHRQLSCTIHGSPRHGSFVQADVTAQPKESTYKPAQPWTYTGYSPAMSRTEPVRCLPIIGKSYKTAHLKSKLTSASLTMEQKPTPENSTLFQGFEWNVPDDHKHWKRLAEQLPKLKAIGITNIWLPPGCKAANPKGVGYDIYDLYDLGEFDQKGAKGTKWGTKEELLELSKVAKEHNVGLYWDAVLNHKAGADRTEKCRVVEVDENDRTKEISDAYEIEGWLGFDFPGRGEQYSKMKYHWEHFSGTDYNQANEKKAIYKILGENKGWSQSVDTESGNADYMMFADIDYSHPEVQADVKNWGVWITKEVGLKGFRLDAVQHFSSRFSNEWIKNLREQCGDDMFIVGEFWSGDVKEMSEWLDGMQHEICLYDSPLLNKFGSLSTCESADLRTVFDDSLVRLRPMDAVTVVTNHDTQPGQVMETKIEGFFKPLAYALILLRQEGYPCPFYGDLYGLSEPHETPASCGGKLADLILARKLFAYGAQEDYLDEANCIGFVRRGTWDKVAGLACVMSNAGPGQIRMAVGEMHAGEKWSDVLGWEQGEVEIDSEGYGVFRCPGTSVAVWVRSDAEGRDQFPTNWDADVYGQGSPPTLFTCPSQACTVVSSDGHYITGKRRHGVMRCRRPLPCRRGSQAVSWWKMRESAWGGRQGCRAAQPITRRTTIAVLDVSRPFWQASMRHPAKHDRRPMPAECSLPLYHDAHAHAHARTRARDTANMRGQRPRPAAGHEAACAM

SEQ ID NO: 475 - DNA, 7181 bp, Fungi
  CDS (1)...(2734): Exon
  CDS (2785)...(7181): Exon
atgcaaacccaattacgacatggaggagatctacagggtctcattgatagtctggactatatacaaggaatgggaataaagggaatttatattgctggaagtcctatgatcaatgcgccttggggcgctgatcaatactctcctctggatttcagtcttctcgaccaacatttcggagatatcgatttgtggaggaaaactaccactgccatccatgacaggggaatgtatgtgatgctcgacaacaccatgggaaccatgggagacttgattgctttcaaaggctatgaaaattcttcgactccgttcaccctgaccgagcacgaagtcctttggcgtaatgacaaccgccaatatctggatttttccttcgggtcgaagtacaatgagacctgcaactaccctagattctggcttgatactggatataccgtcaaggaagatgtcactgacctcatgaatgggtgctatgattccgaattcgatcaatatggtgataccgaagcttttggtgtcttccctgattggcaacgtcagttgtcaaagttcgcctctgtccaggatcgtttgagagaatgggttccatccgtaagaactaaaatcgagatcttcacttgcatgatcatccaacaattggacattgatggactgcgtgtggacaaggcgacacaaattacggtcgatgcattgggaagtttcagtcacgcaatcagagagtgcgcaagagatgtgaacaagacaaatttcatggttactggtgaaatcactggtggaaacacttttggaagtatttacctcgggcgtggacgtcaacctgacatgttaccgtccagcatggcagatgcggttaaattgacctccaattctagtctggcatattttatccgtgatcacgatcaaaacgcgctcgactctgctgcttttcactatagtgtttatcgcacactgaccagatttctgggaatggacggaaacttggcaagtggttatgatacaccaactaactgggtagatgcgtggaacgaaatgcttgtaacgaacgattttgttaaccctaatactggagtgttcgatccaagacatatgtacggagtcagcaatcaggatgttttcagatggccagctatccagaatggcacacaaaaacaacttctagggttcttcatcacgactatacacatgcctggtattcctttgcttttgtggggtgaagaacaagcattctatgtcttagacaatacagccgacaattatctcttcggtcgacaagctatgtctccttctcaagcatggcagactcacggatgctacgcccttggcagtggtacatattatcaattccccaatgactcttgcactcgaggttgcaatgatgattggaacagccgcgatcacagagatccatctcatccagttagaaatattgtcaaggcaatgtaccagatgcgagacaactatccagttttgaccgatggagcatttttacgacaactttccaaccagacaatcgaaatcctcttaccaggtagtaacggaacagctactgaaactggaatgtggagtaccatgcgaggtcaatacgatggtattcaagatttatctaaagctggtggtcaagcaaaccagtctgtttggatggtttaccacaacaattatgacacagttacatattcttttgattgcagtagcaacgaaacctcgcttgttgctcctttccttgacggtgtcactgtcaaaaatttgttctatccgtatgaggaggttacattgaaagcaggtccttttcagctaggaattgcaaatcagactggcttcaatggctgtctcgatagtctcactctcgttccatacgagtataaagcgtatgtgccaaaaaagagctgggttggaccttcgcctatgattacctcattttcaccaggacacgatgcacgacttgtttctacagttgctcccggagaacaagaaaccattgaaattgaatttggcttcagtgccgaaatgaagtgctctgatctcatttcgaaaatggtaattacctcggcaacagaagacggacaggttgcaacactagccaatgccaccggtgaatattcttgtactttgcttccaagtgcggtcaatgtaaccgaattcgtcggatcaattccaaccatgtggactttcaaaggaaatcttaccaatgtatccaacggtgtccactcaatcactctagccaatatcaccagcaactctggaaattcctcaactggagccacagatacattcttgttccgtgttggacaagttgataatcctatcgctttccccggttccgcaaacttcacaagagaattacttcacaagtatgacaatggcacattgtatgtcagccacaaagctgctggagcagatcggttcaaatattctttgaactggggaagttcatggtctgaatggttaccatatgttggtggaaataccacacttgaaccacaggcttggactggtacaagcaaacaaaaatgggacggagatcacgtcatcatgcaatattggagcaaacttactggtagcagtgatgtagttcaacatgctgatctagaaaccaacaaatggtcgcgtcgccttccgcacttgtttgctaatggtccatacaaccagtatggatatgatactggtatcgataatggtttcactttgaacaagaaagacagtctctgggaatataagtttatgactgaatggccagccggtaagttgtatcttcaatccgatgtatcaaggcactctaacaatttctagtcatgcaagtgaatgtttggggtatgaatcctgatgggcaacctgacgaaactatcgtgttgggagatatcgacaatgataatatccttgatcgtatgccaccttcatcgctatccacggcgctcatcaacatcacacgcgtgccaccatcaccatatctcggatacaaaattgcaatcgacgacggtaattatagatactatcaaatcccttacggaaatcgttcctaccaaatgttgatggttgtccttttctggattgtccctgtactcagtggtggtctcagtatctggctgttcatgaaatctttctacgccgtcaaactcaacagtgtcggtgtcaaggaggcaaagaactatatcccattagccttgcgcagaaagctgaagagagaaaagaaagaggacccatctgagaaagaaatgaccgtcatgggaggattgcactcaatgttccacgaaaatgccacacaacttggactgcaggctgatgttgcagcgaccggacgacgaactgtacttattgctactatggaatatgatattgaagattgggctatcaagatcaagattggtggtcttggtgtcatggcacaattgatgggaaagaatttgggtcatcaagatctcatttgggtcgttccttgtgttggtggtatcgattatcctatcgatcaccaagctgaacctatggatgtcacaattcttggaaattcctacactgttcaagttcagtaccatactctacgaaacatcacttacgttcttctcgatgcaccagttttcagagcacaatctaagtctgagccatacccagctcgtatggatgatttagactcggccgtttactacagtgcttggaatcaatgtatcgctcttaccatcaagcgtttccccgtcgatttgtatcacatcaacgattaccacggagccgttgcaccagtccatcttcttccagaaacgattccatgttgtttgtccctccacaacgccgagttccaagggttatggcccatgcgtaaccagaaagagagaagtgaagtctgtcaagtctacaacattccagaagaagtcgccatcaaatacgttcaattcggagatgtgttcaatttgctccacgccggaagttcttatcttcgtattcatcaaaagggtttcggtgctgttggtgtcagtaagaaatacggaaagcgttcctgggcaagatatcctattttctggggattgagcaagatcggcaatcttcctaatcctgatccttctgatactggagactggaatggtactcaagattcaacgggcaagacaattgttaaccaggattttgaaagtcaaagagccgacctcaaaagacaagcacaggaatgggccggtctcgaacaaaatcctaaagccgaacttttggttttcgtcggtagatggtcgatgcaaaagggtattgatttgattgctgatgttatgcctgctgttttggaggagaatccaaatgttcaacttatttgcgttggtcctgttattgatctttatggaaaattcgccgctctcaaactcgatgtcatgatgacaaaatacaagggccgtgtcttcagtaagcctgagttcactgctcttccaccattcattttctcgggagccgaattcgccttgattccatctagagatgaacctttcggtcttgtcgctgtagagtttggtagaaaaggagctttgggtattggtgctcgtgttggtggtcttggtcaaatgcctggttggtggttcactgtcgaatctactacgacaacccatatgcttcatcaattcaaacaagccattaaggaagccttggcctccaaattggaaactcgtcaaataatgagagcacgatctgcaaagcaacgtttcccagtcgctcaatgggtcaatgatcttgagatattgcaaagtaaagcaatcaagattcacgataaggaagaggccaaacattctggtagaccaagatctagaggaagagatggaggaaatattttctattcttccgctaagagattatcgagttttggtaccagttttgctagtacctcacaacttgatgttgccagtaccattggtggctctaccagaccatcatcgccaactcgtgttgaacagccaccggcaggaggtggactgagccgaaagctttctttgggatacagagctggcccgggacatcgcgtaacgaaaaatagattcaatggcagtaatgcaccgggtgctggaatcaaaaatgacgaaggacttaccgatgtggatgaggacagcgatgatgaagatgcccgaattcgtgacgacatatacgatgaatacgtactcacccctgaagaactagaagcacagagacaacaagagcaatggagaggacaagctgaaagtcccgcagcaggaggcgcattcctcgcaccacaaccaggattcttggattctccacgcagaagtccaagtgccaatactggtagtttgcatatcaacgattccgaactgtcgttgccacgtctcaaggatggctcaaatatttattccacccactcgatacctggctctcctggtttagagtcacctggaactccgggagcacacgattctttgcttcctcctccatcaatctttggagccggtggtgacaacgcaaacagagcttccatgcttagtttgagttccgttatcggagacaagacagatttcaaacttcaaaaggtcgatccattcttcactgatactcaaggagaatactatcaacaatttgccaggaatcttgataatctggatggaaagaacagtgaaggacaattgtgtatcgaggaatatctgatcaaatctgaaaagaaatggtttgacaggttccgtgatgcaaaattgggaagaaactcagttgcaccttcgttctctgcccttggaagtggacgaagatctcacgatagccgtggacgatccaacagtcgggatagctttaccaacgataccattacccactcaaggcaaaattctagtcaagataacatggcactcactggcggatctactgccaatgatcaattcttacttggcaaagattataaaccacctactggtcttcgtctggtcatgcaataccgcttctttgattggcctgtctactcattcttactcgccttcggtcaaatcatcgcagctaattcttatcaaatcactcttcttaccggtactgtgggtcaaagtgcagagaaactttacatcacagcaacgatctatcttgttacctcgatcatgtggtgggaagtcttttccttcttcaaatcaatctacgtcctcagtattccattcatcttttacggattggcctttttcctcctcggcatggctcctttcgtagacggtgctgatggaaggggttgggtccagaacgtagctactggtttgtatgctgttgccgcttcatcgggtagtattttcttcgctttgaatttcggagatgaaggaggatctcctgtgaaagcctgggttttccgcgcctgcatcattcaaggaacacaacaagcttatgtcgtcattctctggttctggggatcttatctcaacagacgtcaagctgatggtcttggaacttccttcacatctgctagtcccaaaatgtctgcagtcgttcttcctattgccgtactcatgtgggcggttggtctcatcactttcctcggattgccagaatattatcgacaagcgcctggaaaagtaccatctttctacgcctcgctcttcagacgtaagattgtcatgtggtttttcgtcactgttttgattcagaacttcttcctctcgacgctctatggtcgtaactggctttatctattctcctctaaccatgctcctacatgggccatcatccttctcatcatcttcttctttggattcttatgggcaggcttcctctggttcttcgcaatcttgagtaaagatcacagttgggttctaccaattttcgccattggtctcggagctcctagatggtgtcaaatgctctggtcttgcacaccgataggacaatacgtaccatgggttggcggtgggcttgccagtgctatcttctctcgatcattgtggctttggctcggtatgctcgatgcacttcaaggtgtgggattcggtatgctgttgcttcaaactcttactcgtgttcatattgctttcactctcatcgcggctcaagttttgggttcaatagctactatggtagccagagcatgtgcaccaaataaaattggacctggaactgtcttccctgattttagtgacggggcggctggacttggaaatgggtggttttggatcgggttgattttacaactcgttatttgcggtggatttttcacattcttcagaaaagagcaacttagcaagccttag

SEQ ID NO: 476 - protein, 911 aa, Fungi
MQTQLRHGGDLQGLIDSLDYIQGMGIKGIYIAGSPMINAPWGADQYSPLDFSLLDQHFGDIDLWRKTTTAIHDRGMYVMLDNTMGTMGDLIAFKGYENSSTPFTLTEHEVLWRNDNRQYLDFSFGSKYNETCNYPRFWLDTGYTVKEDVTDLMNGCYDSEFDQYGDTEAFGVFPDWQRQLSKFASVQDRLREWVPSVRTKIEIFTCMIIQQLDIDGLRVDKATQITVDALGSFSHAIRECARDVNKTNFMVTGEITGGNTFGSIYLGRGRQPDMLPSSMADAVKLTSNSSLAYFIRDHDQNALDSAAFHYSVYRTLTRFLGMDGNLASGYDTPTNWVDAWNEMLVTNDFVNPNTGVFDPRHMYGVSNQDVFRWPAIQNGTQKQLLGFFITTIHMPGIPLLLWGEEQAFYVLDNTADNYLFGRQAMSPSQAWQTHGCYALGSGTYYQFPNDSCTRGCNDDWNSRDHRDPSHPVRNIVKAMYQMRDNYPVLTDGAFLRQLSNQTIEILLPGSNGTATETGMWSTMRGQYDGIQDLSKAGGQANQSVWMVYHNNYDTVTYSFDCSSNETSLVAPFLDGVTVKNLFYPYEEVTLKAGPFQLGIANQTGFNGCLDSLTLVPYEYKAYVPKKSWVGPSPMITSFSPGHDARLVSTVAPGEQETIEIEFGFSAEMKCSDLISKMVITSATEDGQVATLANATGEYSCTLLPSAVNVTEFVGSIPTMWTFKGNLTNVSNGVHSITLANITSNSGNSSTGATDTFLFRVGQVDNPIAFPGSANFTRELLHKYDNGTLYVSHKAAGADRFKYSLNWGSSWSEWLPYVGGNTTLEPQAWTGTSKQKWDGDHVIMQYWSKLTGSSDVVQHADLETNKWSRRLPHLFANGPYNQYGYDTGIDNGFTLNKKDSLWEYKFMTEWPA

SEQ ID NO: 477 - protein, 1465 aa, Fungi
VMQVNVWGMNPDGQPDETIVLGDIDNDNILDRMPPSSLSTALINITRVPPSPYLGYKIAIDDGNYRYYQIPYGNRSYQMLMVVLFWIVPVLSGGLSIWLFMKSFYAVKLNSVGVKEAKNYIPLALRRKLKREKKEDPSEKEMTVMGGLHSMFHENATQLGLQADVAATGRRTVLIATMEYDIEDWAIKIKIGGLGVMAQLMGKNLGHQDLIWVVPCVGGIDYPIDHQAEPMDVTILGNSYTVQVQYHTLRNITYVLLDAPVFRAQSKSEPYPARMDDLDSAVYYSAWNQCIALTIKRFPVDLYHINDYHGAVAPVHLLPETIPCCLSLHNAEFQGLWPMRNQKERSEVCQVYNIPEEVAIKYVQFGDVFNLLHAGSSYLRIHQKGFGAVGVSKKYGKRSWARYPIFWGLSKIGNLPNPDPSDTGDWNGTQDSTGKTIVNQDFESQRADLKRQAQEWAGLEQNPKAELLVFVGRWSMQKGIDLIADVMPAVLEENPNVQLICVGPVIDLYGKFAALKLDVMMTKYKGRVFSKPEFTALPPFIFSGAEFALIPSRDEPFGLVAVEFGRKGALGIGARVGGLGQMPGWWFTVESTTTTHMLHQFKQAIKEALASKLETRQIMRARSAKQRFPVAQWVNDLEILQSKAIKIHDKEEAKHSGRPRSRGRDGGNIFYSSAKRLSSFGTSFASTSQLDVASTIGGSTRPSSPTRVEQPPAGGGLSRKLSLGYRAGPGHRVTKNRFNGSNAPGAGIKNDEGLTDVDEDSDDEDARIRDDIYDEYVLTPEELEAQRQQEQWRGQAESPAAGGAFLAPQPGFLDSPRRSPSANTGSLHINDSELSLPRLKDGSNIYSTHSIPGSPGLESPGTPGAHDSLLPPPSIFGAGGDNANRASMLSLSSVIGDKTDFKLQKVDPFFTDTQGEYYQQFARNLDNLDGKNSEGQLCIEEYLIKSEKKWFDRFRDAKLGRNSVAPSFSALGSGRRSHDSRGRSNSRDSFTNDTITHSRQNSSQDNMALTGGSTANDQFLLGKDYKPPTGLRLVMQYRFFDWPVYSFLLAFGQIIAANSYQITLLTGTVGQSAEKLYITATIYLVTSIMWWEVFSFFKSIYVLSIPFIFYGLAFFLLGMAPFVDGADGRGWVQNVATGLYAVAASSGSIFFALNFGDEGGSPVKAWVFRACIIQGTQQAYVVILWFWGSYLNRRQADGLGTSFTSASPKMSAVVLPIAVLMWAVGLITFLGLPEYYRQAPGKVPSFYASLFRRKIVMWFFVTVLIQNFFLSTLYGRNWLYLFSSNHAPTWAIILLIIFFFGFLWAGFLWFFAILSKDHSWVLPIFAIGLGAPRWCQMLWSCTPIGQYVPWVGGGLASAIFSRSLWLWLGMLDALQGVGFGMLLLQTLTRVHIAFTLIAAQVLGSIATMVARACAPNKIGPGTVFPDFSDGAAGLGNGWFWIGLILQLVICGGFFTFFRKEQLSKP

SEQ ID NO: 478 - DNA, 7131 bp, Fungi
atgcaaacccaattacgacatggaggagatctacagggtctcattgatagtctggactatatacaaggaatgggaataaagggaatttatattgctggaagtcctatgatcaatgcgccttggggcgctgatcaatactctcctctggatttcagtcttctcgaccaacatttcggagatatcgatttgtggaggaaaactaccactgccatccatgacaggggaatgtatgtgatgctcgacaacaccatgggaaccatgggagacttgattgctttcaaaggctatgaaaattcttcgactccgttcaccctgaccgagcacgaagtcctttggcgtaatgacaaccgccaatatctggatttttccttcgggtcgaagtacaatgagacctgcaactaccctagattctggcttgatactggatataccgtcaaggaagatgtcactgacctcatgaatgggtgctatgattccgaattcgatcaatatggtgataccgaagcttttggtgtcttccctgattggcaacgtcagttgtcaaagttcgcctctgtccaggatcgtttgagagaatgggttccatccgtaagaactaaaatcgagatcttcacttgcatgatcatccaacaattggacattgatggactgcgtgtggacaaggcgacacaaattacggtcgatgcattgggaagtttcagtcacgcaatcagagagtgcgcaagagatgtgaacaagacaaatttcatggttactggtgaaatcactggtggaaacacttttggaagtatttacctcgggcgtggacgtcaacctgacatgttaccgtccagcatggcagatgcggttaaattgacctccaattctagtctggcatattttatccgtgatcacgatcaaaacgcgctcgactctgctgcttttcactatagtgtttatcgcacactgaccagatttctgggaatggacggaaacttggcaagtggttatgatacaccaactaactgggtagatgcgtggaacgaaatgcttgtaacgaacgattttgttaaccctaatactggagtgttcgatccaagacatatgtacggagtcagcaatcaggatgttttcagatggccagctatccagaatggcacacaaaaacaacttctagggttcttcatcacgactatacacatgcctggtattcctttgcttttgtggggtgaagaacaagcattctatgtcttagacaatacagccgacaattatctcttcggtcgacaagctatgtctccttctcaagcatggcagactcacggatgctacgcccttggcagtggtacatattatcaattccccaatgactcttgcactcgaggttgcaatgatgattggaacagccgcgatcacagagatccatctcatccagttagaaatattgtcaaggcaatgtaccagatgcgagacaactatccagttttgaccgatggagcatttttacgacaactttccaaccagacaatcgaaatcctcttaccaggtagtaacggaacagctactgaaactggaatgtggagtaccatgcgaggtcaatacgatggtattcaagatttatctaaagctggtggtcaagcaaaccagtctgtttggatggtttaccacaacaattatgacacagttacatattcttttgattgcagtagcaacgaaacctcgcttgttgctcctttccttgacggtgtcactgtcaaaaatttgttctatccgtatgaggaggttacattgaaagcaggtccttttcagctaggaattgcaaatcagactggcttcaatggctgtctcgatagtctcactctcgttccatacgagtataaagcgtatgtgccaaaaaagagctgggttggaccttcgcctatgattacctcattttcaccaggacacgatgcacgacttgtttctacagttgctcccggagaacaagaaaccattgaaattgaatttggcttcagtgccgaaatgaagtgctctgatctcatttcgaaaatggtaattacctcggcaacagaagacggacaggttgcaacactagccaatgccaccggtgaatattcttgtactttgcttccaagtgcggtcaatgtaaccgaattcgtcggatcaattccaaccatgtggactttcaaaggaaatcttaccaatgtatccaacggtgtccactcaatcactctagccaatatcaccagcaactctggaaattcctcaactggagccacagatacattcttgttccgtgttggacaagttgataatcctatcgctttccccggttccgcaaacttcacaagagaattacttcacaagtatgacaatggcacattgtatgtcagccacaaagctgctggagcagatcggttcaaatattctttgaactggggaagttcatggtctgaatggttaccatatgttggtggaaataccacacttgaaccacaggcttggactggtacaagcaaacaaaaatgggacggagatcacgtcatcatgcaatattggagcaaacttactggtagcagtgatgtagttcaacatgctgatctagaaaccaacaaatggtcgcgtcgccttccgcacttgtttgctaatggtccatacaaccagtatggatatgatactggtatcgataatggtttcactttgaacaagaaagacagtctctgggaatataagtttatgactgaatggccagccgtcatgcaagtgaatgtttggggtatgaatcctgatgggcaacctgacgaaactatcgtgttgggagatatcgacaatgataatatccttgatcgtatgccaccttcatcgctatccacggcgctcatcaacatcacacgcgtgccaccatcaccatatctcggatacaaaattgcaatcgacgacggtaattatagatactatcaaatcccttacggaaatcgttcctaccaaatgttgatggttgtccttttctggattgtccctgtactcagtggtggtctcagtatctggctgttcatgaaatctttctacgccgtcaaactcaacagtgtcggtgtcaaggaggcaaagaactatatcccattagccttgcgcagaaagctgaagagagaaaagaaagaggacccatctgagaaagaaatgaccgtcatgggaggattgcactcaatgttccacgaaaatgccacacaacttggactgcaggctgatgttgcagcgaccggacgacgaactgtacttattgctactatggaatatgatattgaagattgggctatcaagatcaagattggtggtcttggtgtcatggcacaattgatgggaaagaatttgggtcatcaagatctcatttgggtcgttccttgtgttggtggtatcgattatcctatcgatcaccaagctgaacctatggatgtcacaattcttggaaattcctacactgttcaagttcagtaccatactctacgaaacatcacttacgttcttctcgatgcaccagttttcagagcacaatctaagtctgagccatacccagctcgtatggatgatttagactcggccgtttactacagtgcttggaatcaatgtatcgctcttaccatcaagcgtttccccgtcgatttgtatcacatcaacgattaccacggagccgttgcaccagtccatcttcttccagaaacgattccatgttgtttgtccctccacaacgccgagttccaagggttatggcccatgcgtaaccagaaagagagaagtgaagtctgtcaagtctacaacattccagaagaagtcgccatcaaatacgttcaattcggagatgtgttcaatttgctccacgccggaagttcttatcttcgtattcatcaaaagggtttcggtgctgttggtgtcagtaagaaatacggaaagcgttcctgggcaagatatcctattttctggggattgagcaagatcggcaatcttcctaatcctgatccttctgatactggagactggaatggtactcaagattcaacgggcaagacaattgttaaccaggattttgaaagtcaaagagccgacctcaaaagacaagcacaggaatgggccggtctcgaacaaaatcctaaagccgaacttttggttttcgtcggtagatggtcgatgcaaaagggtattgatttgattgctgatgttatgcctgctgttttggaggagaatccaaatgttcaacttatttgcgttggtcctgttattgatctttatggaaaattcgccgctctcaaactcgatgtcatgatgacaaaatacaagggccgtgtcttcagtaagcctgagttcactgctcttccaccattcattttctcgggagccgaattcgccttgattccatctagagatgaacctttcggtcttgtcgctgtagagtttggtagaaaaggagctttgggtattggtgctcgtgttggtggtcttggtcaaatgcctggttggtggttcactgtcgaatctactacgacaacccatatgcttcatcaattcaaacaagccattaaggaagccttggcctccaaattggaaactcgtcaaataatgagagcacgatctgcaaagcaacgtttcccagtcgctcaatgggtcaatgatcttgagatattgcaaagtaaagcaatcaagattcacgataaggaagaggccaaacattctggtagaccaagatctagaggaagagatggaggaaatattttctattcttccgctaagagattatcgagttttggtaccagttttgctagtacctcacaacttgatgttgccagtaccattggtggctctaccagaccatcatcgccaactcgtgttgaacagccaccggcaggaggtggactgagccgaaagctttctttgggatacagagctggcccgggacatcgcgtaacgaaaaatagattcaatggcagtaatgcaccgggtgctggaatcaaaaatgacgaaggacttaccgatgtggatgaggacagcgatgatgaagatgcccgaattcgtgacgacatatacgatgaatacgtactcacccctgaagaactagaagcacagagacaacaagagcaatggagaggacaagctgaaagtcccgcagcaggaggcgcattcctcgcaccacaaccaggattcttggattctccacgcagaagtccaagtgccaatactggtagtttgcatatcaacgattccgaactgtcgttgccacgtctcaaggatggctcaaatatttattccacccactcgatacctggctctcctggtttagagtcacctggaactccgggagcacacgattctttgcttcctcctccatcaatctttggagccggtggtgacaacgcaaacagagcttccatgcttagtttgagttccgttatcggagacaagacagatttcaaacttcaaaaggtcgatccattcttcactgatactcaaggagaatactatcaacaatttgccaggaatcttgataatctggatggaaagaacagtgaaggacaattgtgtatcgaggaatatctgatcaaatctgaaaagaaatggtttgacaggttccgtgatgcaaaattgggaagaaactcagttgcaccttcgttctctgcccttggaagtggacgaagatctcacgatagccgtggacgatccaacagtcgggatagctttaccaacgataccattacccactcaaggcaaaattctagtcaagataacatggcactcactggcggatctactgccaatgatcaattcttacttggcaaagattataaaccacctactggtcttcgtctggtcatgcaataccgcttctttgattggcctgtctactcattcttactcgccttcggtcaaatcatcgcagctaattcttatcaaatcactcttcttaccggtactgtgggtcaaagtgcagagaaactttacatcacagcaacgatctatcttgttacctcgatcatgtggtgggaagtcttttccttcttcaaatcaatctacgtcctcagtattccattcatcttttacggattggcctttttcctcctcggcatggctcctttcgtagacggtgctgatggaaggggttgggtccagaacgtagctactggtttgtatgctgttgccgcttcatcgggtagtattttcttcgctttgaatttcggagatgaaggaggatctcctgtgaaagcctgggttttccgcgcctgcatcattcaaggaacacaacaagcttatgtcgtcattctctggttctggggatcttatctcaacagacgtcaagctgatggtcttggaacttccttcacatctgctagtcccaaaatgtctgcagtcgttcttcctattgccgtactcatgtgggcggttggtctcatcactttcctcggattgccagaatattatcgacaagcgcctggaaaagtaccatctttctacgcctcgctcttcagacgtaagattgtcatgtggtttttcgtcactgttttgattcagaacttcttcctctcgacgctctatggtcgtaactggctttatctattctcctctaaccatgctcctacatgggccatcatccttctcatcatcttcttctttggattcttatgggcaggcttcctctggttcttcgcaatcttgagtaaagatcacagttgggttctaccaattttcgccattggtctcggagctcctagatggtgtcaaatgctctggtcttgcacaccgataggacaatacgtaccatgggttggcggtgggcttgccagtgctatcttctctcgatcattgtggctttggctcggtatgctcgatgcacttcaaggtgtgggattcggtatgctgttgcttcaaactcttactcgtgttcatattgctttcactctcatcgcggctcaagttttgggttcaatagctactatggtagccagagcatgtgcaccaaataaaattggacctggaactgtcttccctgattttagtgacggggcggctggacttggaaatgggtggttttggatcgggttgattttacaactcgttatttgcggtggatttttcacattcttcagaaaagagcaacttagcaagccttag

SEQ ID NO: 479 - protein, 2376 aa, Fungi
MQTQLRHGGDLQGLIDSLDYIQGMGIKGIYIAGSPMINAPWGADQYSPLDFSLLDQHFGDIDLWRKTTTAIHDRGMYVMLDNTMGTMGDLIAFKGYENSSTPFTLTEHEVLWRNDNRQYLDFSFGSKYNETCNYPRFWLDTGYTVKEDVTDLMNGCYDSEFDQYGDTEAFGVFPDWQRQLSKFASVQDRLREWVPSVRTKIEIFTCMIIQQLDIDGLRVDKATQITVDALGSFSHAIRECARDVNKTNFMVTGEITGGNTFGSIYLGRGRQPDMLPSSMADAVKLTSNSSLAYFIRDHDQNALDSAAFHYSVYRTLTRFLGMDGNLASGYDTPTNWVDAWNEMLVTNDFVNPNTGVFDPRHMYGVSNQDVFRWPAIQNGTQKQLLGFFITTIHMPGIPLLLWGEEQAFYVLDNTADNYLFGRQAMSPSQAWQTHGCYALGSGTYYQFPNDSCTRGCNDDWNSRDHRDPSHPVRNIVKAMYQMRDNYPVLTDGAFLRQLSNQTIEILLPGSNGTATETGMWSTMRGQYDGIQDLSKAGGQANQSVWMVYHNNYDTVTYSFDCSSNETSLVAPFLDGVTVKNLFYPYEEVTLKAGPFQLGIANQTGFNGCLDSLTLVPYEYKAYVPKKSWVGPSPMITSFSPGHDARLVSTVAPGEQETIEIEFGFSAEMKCSDLISKMVITSATEDGQVATLANATGEYSCTLLPSAVNVTEFVGSIPTMWTFKGNLTNVSNGVHSITLANITSNSGNSSTGATDTFLFRVGQVDNPIAFPGSANFTRELLHKYDNGTLYVSHKAAGADRFKYSLNWGSSWSEWLPYVGGNTTLEPQAWTGTSKQKWDGDHVIMQYWSKLTGSSDVVQHADLETNKWSRRLPHLFANGPYNQYGYDTGIDNGFTLNKKDSLWEYKFMTEWPAVMQVNVWGMNPDGQPDETIVLGDIDNDNILDRMPPSSLSTALINITRVPPSPYLGYKIAIDDGNYRYYQIPYGNRSYQMLMVVLFWIVPVLSGGLSIWLFMKSFYAVKLNSVGVKEAKNYIPLALRRKLKREKKEDPSEKEMTVMGGLHSMFHENATQLGLQADVAATGRRTVLIATMEYDIEDWAIKIKIGGLGVMAQLMGKNLGHQDLIWVVPCVGGIDYPIDHQAEPMDVTILGNSYTVQVQYHTLRNITYVLLDAPVFRAQSKSEPYPARMDDLDSAVYYSAWNQCIALTIKRFPVDLYHINDYHGAVAPVHLLPETIPCCLSLHNAEFQGLWPMRNQKERSEVCQVYNIPEEVAIKYVQFGDVFNLLHAGSSYLRIHQKGFGAVGVSKKYGKRSWARYPIFWGLSKIGNLPNPDPSDTGDWNGTQDSTGKTIVNQDFESQRADLKRQAQEWAGLEQNPKAELLVFVGRWSMQKGIDLIADVMPAVLEENPNVQLICVGPVIDLYGKFAALKLDVMMTKYKGRVFSKPEFTALPPFIFSGAEFALIPSRDEPFGLVAVEFGRKGALGIGARVGGLGQMPGWWFTVESTTTTHMLHQFKQAIKEALASKLETRQIMRARSAKQRFPVAQWVNDLEILQSKAIKIHDKEEAKHSGRPRSRGRDGGNIFYSSAKRLSSFGTSFASTSQLDVASTIGGSTRPSSPTRVEQPPAGGGLSRKLSLGYRAGPGHRVTKNRFNGSNAPGAGIKNDEGLTDVDEDSDDEDARIRDDIYDEYVLTPEELEAQRQQEQWRGQAESPAAGGAFLAPQPGFLDSPRRSPSANTGSLHINDSELSLPRLKDGSNIYSTHSIPGSPGLESPGTPGAHDSLLPPPSIFGAGGDNANRASMLSLSSVIGDKTDFKLQKVDPFFTDTQGEYYQQFARNLDNLDGKNSEGQLCIEEYLIKSEKKWFDRFRDAKLGRNSVAPSFSALGSGRRSHDSRGRSNSRDSFTNDTITHSRQNSSQDNMALTGGSTANDQFLLGKDYKPPTGLRLVMQYRFFDWPVYSFLLAFGQIIAANSYQITLLTGTVGQSAEKLYITATIYLVTSIMWWEVFSFFKSIYVLSIPFIFYGLAFFLLGMAPFVDGADGRGWVQNVATGLYAVAASSGSIFFALNFGDEGGSPVKAWVFRACIIQGTQQAYVVILWFWGSYLNRRQADGLGTSFTSASPKMSAVVLPIAVLMWAVGLITFLGLPEYYRQAPGKVPSFYASLFRRKIVMWFFVTVLIQNFFLSTLYGRNWLYLFSSNHAPTWAIILLIIFFFGFLWAGFLWFFAILSKDHSWVLPIFAIGLGAPRWCQMLWSCTPIGQYVPWVGGGLASAIFSRSLWLWLGMLDALQGVGFGMLLLQTLTRVHIAFTLIAAQVLGSIATMVARACAPNKIGPGTVFPDFSDGAAGLGNGWFWIGLILQLVICGGFFTFFRKEQLSKP

SEQ ID NO: 480 - DNA, 1511 bp, Fungi
  CDS (1)...(263): Exon
  CDS (312)...(417): Exon
  CDS (498)...(1510): Exon
atgaagttctctcttcttgcgaccatcgtcgctagcattagtccgcttgcacgcgcagcagatgcaaacgcttggaagtcgcgaaatatttacttcgcacttactgatcgtgttgcgcggagtgctgatgataatggcggcagtgcatgcggaaacctcgggaattactgtggtggaacttttaagggcttagagtcaaagcttgattatatcaagggcatgggatttgatgctatttggattactcctgttgttgacagtaggtggtgcgaaattgagtgaaaaaatgtgactgacagggtgatagatactgatgggggataccatggatactgggctaaggatctgtatgcggtcaactccaagtatggtactgcagatgatttgaagagtcttgtcaaatctgctcatgacaaggtaagcaaagttcctctcctcatgctgttcttctgtgatcgccttggtctttcttggtgatcccgtgctgactgttccagaacatgtacgtcatgtgcgacgtcgtcgcaaaccacatgggcaaaggcatctcagaccacaaaccctcccccctcaacgaacaaagctcataccacaccccctgcgatatcgactacagcaaccagaccagcatcgagcagtgcgaaatcgccggtcttcccgacctcaacaccggcagcgacaccgtcaagaaagtcctctacgactggatcaagtggcttgtctccgagtacagcttcgacggtatccgcatcgatacagtcaaacatgtcgaaaagccgttctggcctggttttcaagacgctgctggtgtttacgccatcggtgaggtttgggatggagggcctgattacctagctggttatgcacaggtcatgcctggtctcttgaactatgctatgtattaccccatgaaccggttctaccagcaaaaaggcgatccttcagatgttgtcgctatgcacgatgagattagcaacaaattccccgatcccactatcctcggaacattcatcgacaaccacgataaccctcgctggttgagccaaaagaacgacaaagctctcctcaagaacgccctcgcatacgtcatcctagcccgaggtattcccatcgtctactacggaacagagcaaggttacgctggcggcaatgatcccgccaaccgtgaggatctctggcgaagcagcttcagcaccgacgcggatctgtatcaacacatttcacgcctctccaaggctcgctcggcggtcggtggtcttggtggaaatgatcacaagcatctctactcgcaggacagcgcgtatgcttggagtcgtgctgatggcgatctcattgttcttactttgaaccgcggacaggggtactcggggcaatactgctttaacactggaaagaacaacaagacttgggacagagtctttggaagtggaactgttacctctgatggcaatggtcaggtttgtgttagctacactaacggcgagcctgaagtcttggttgcgtctagctag

SEQ ID NO: 481 - protein, 88 aa, Fungi
MKFSLLATIVASISPLARAADANAWKSRNIYFALTDRVARSADDNGGSACGNLGNYCGGTFKGLESKLDYIKGMGFDAIWITPVVDSS

SEQ ID NO: 482 - protein, 35 aa, Fungi
DGGYHGYWAKDLYAVNSKYGTADDLKSLVKSAHDK

SEQ ID NO: 483 - protein, 337 aa, Fungi
NMYVMCDVVANHMGKGISDHKPSPLNEQSSYHTPCDIDYSNQTSIEQCEIAGLPDLNTGSDTVKKVLYDWIKWLVSEYSFDGIRIDTVKHVEKPFWPGFQDAAGVYAIGEVWDGGPDYLAGYAQVMPGLLNYAMYYPMNRFYQQKGDPSDVVAMHDEISNKFPDPTILGTFIDNHDNPRWLSQKNDKALLKNALAYVILARGIPIVYYGTEQGYAGGNDPANREDLWRSSFSTDADLYQHISRLSKARSAVGGLGGNDHKHLYSQDSAYAWSRADGDLIVLTLNRGQGYSGQYCFNTGKNNKTWDRVFGSGTVTSDGNGQVCVSYTNGEPEVLVASS

SEQ ID NO: 484 - DNA, 1383 bp, Fungi
atgaagttctctcttcttgcgaccatcgtcgctagcattagtccgcttgcacgcgcagcagatgcaaacgcttggaagtcgcgaaatatttacttcgcacttactgatcgtgttgcgcggagtgctgatgataatggcggcagtgcatgcggaaacctcgggaattactgtggtggaacttttaagggcttagagtcaaagcttgattatatcaagggcatgggatttgatgctatttggattactcctgttgttgacagtagtgatgggggataccatggatactgggctaaggatctgtatgcggtcaactccaagtatggtactgcagatgatttgaagagtcttgtcaaatctgctcatgacaagaacatgtacgtcatgtgcgacgtcgtcgcaaaccacatgggcaaaggcatctcagaccacaaaccctcccccctcaacgaacaaagctcataccacaccccctgcgatatcgactacagcaaccagaccagcatcgagcagtgcgaaatcgccggtcttcccgacctcaacaccggcagcgacaccgtcaagaaagtcctctacgactggatcaagtggcttgtctccgagtacagcttcgacggtatccgcatcgatacagtcaaacatgtcgaaaagccgttctggcctggttttcaagacgctgctggtgtttacgccatcggtgaggtttgggatggagggcctgattacctagctggttatgcacaggtcatgcctggtctcttgaactatgctatgtattaccccatgaaccggttctaccagcaaaaaggcgatccttcagatgttgtcgctatgcacgatgagattagcaacaaattccccgatcccactatcctcggaacattcatcgacaaccacgataaccctcgctggttgagccaaaagaacgacaaagctctcctcaagaacgccctcgcatacgtcatcctagcccgaggtattcccatcgtctactacggaacagagcaaggttacgctggcggcaatgatcccgccaaccgtgaggatctctggcgaagcagcttcagcaccgacgcggatctgtatcaacacatttcacgcctctccaaggctcgctcggcggtcggtggtcttggtggaaatgatcacaagcatctctactcgcaggacagcgcgtatgcttggagtcgtgctgatggcgatctcattgttcttactttgaaccgcggacaggggtactcggggcaatactgctttaacactggaaagaacaacaagacttgggacagagtctttggaagtggaactgttacctctgatggcaatggtcaggtttgtgttagctacactaacggcgagcctgaagtcttggttgcgtctagctag

SEQ ID NO: 485 - protein, 460 aa, Fungi
  SIGNAL (1)...(19)
  DOMAIN (32)...(371): Alpha amylase, catalytic domain
MKFSLLATIVASISPLARAADANAWKSRNIYFALTDRVARSADDNGGSACGNLGNYCGGTFKGLESKLDYIKGMGFDAIWITPVVDSSDGGYHGYWAKDLYAVNSKYGTADDLKSLVKSAHDKNMYVMCDVVANHMGKGISDHKPSPLNEQSSYHTPCDIDYSNQTSIEQCEIAGLPDLNTGSDTVKKVLYDWIKWLVSEYSFDGIRIDTVKHVEKPFWPGFQDAAGVYAIGEVWDGGPDYLAGYAQVMPGLLNYAMYYPMNRFYQQKGDPSDVVAMHDEISNKFPDPTILGTFIDNHDNPRWLSQKNDKALLKNALAYVILARGIPIVYYGTEQGYAGGNDPANREDLWRSSFSTDADLYQHISRLSKARSAVGGLGGNDHKHLYSQDSAYAWSRADGDLIVLTLNRGQGYSGQYCFNTGKNNKTWDRVFGSGTVTSDGNGQVCVSYTNGEPEVLVASS

SEQ ID NO: 486 - DNA, 2131 bp, Fungi
  CDS (1)...(61): Exon
  CDS (108)...(356): Exon
  CDS (410)...(625): Exon
  CDS (673)...(1270): Exon
  CDS (1324)...(2131): Exon
atgagacgaaaaagtacagacaagtacaagaaagtatcaataagagctcatcttgctgcatgttattttgtttgtacgacagttgtttcttcttttcttgacttgaggtgaacaattggcaatatccaagatgctgttttctcgaactgccacgattttgtctctgctatgtgtacaagcaactgcaatttcaccgagaggttcggccgcaagttatagtagtcttgattccttcattgcttccgagagaaagattgctctgcagggtgttctcaacaatattggaccagacggatcgaaagcatcaggagcaggcaattatgtcattgcaagtccttccaagaccaatcctgattgtaagaaataccaatgttatgtttccaggccgaatcttgctaattgattccagacttctatacctggactcgagattctgcgttaacgttaaaaatgcttgttgatgaatttatttttggcaatcgtgcactccagcctcagattgagaaatacgtgaaagctcaagccatccttcaaactgttacgaatccttctggcactttccttcctaacggtttaggacttggtgaacccaaatacgaggttgacggtactcgatttaatggtggtatgtaattttcagaggtaacttctggcactgctgacgttccccagcatggggtagacctcagcgcgatggtccagctcttcgtgctatcgcattaatggcctacagcgattggttaattaatcataatcagcttcaaagagccaagctagttatatggcctataatctcaaatgacttatcatacattggcgaatattggaaccaaactggatatgatttatgggaagaagttctaggatctagcttttttaccgtacaaaatcaacaccgtgcttttgttgaagccggaaatctggccaatagactcggtgttgaatctccaggatatcttaatgcattagaagctctatgcttccttaatcaaagtttttggaacggagaatatatcgtttcgaacatcaatgtcgataacggaagaactgggttagacggagcctcaattcttggatctatttctatcttcgatattgatggctcttgcgatagcccaaatttacaaccgtgtagtagcagagcgttgtctaattttagggcagtcgtgaacagcttccgattttatagtatcaatgctggtattaaaaacaattcaggtatcgccgttggaagatatgccgaagacatttatcaaggaggaaatccatggtactccattccacccctctgcggctcattacctttgaggctaactctcgcaggtacttacttaccactgcggccgcagaatttctttatgatgctgttgcacaatggagaaatcagaaaaaacttaccgttgattcaacatccattaatttcttccgcgatctttacccatctatcaaacttaagagttacacaaacagggacaacgaatttaacaagattcttaatgtcgtaacaaaatacgccgactcttttgtcgcaattgctcaaaaatatacacccagtagtggatctttagccgaacaattcgatcgcaatacaggagcccccatttctgccaatgaccttacatggagttatgcggcatttgtcaccatggctcaaagacgttcaggtcaatatcctgctagttggggaagtgcggcagcatcggttccacccccaaattgcgcatcttcatcttctcaaggagtgtatgttccagccattgcagcaggggccccaaatgtaacggcaacatgtcaatatccagtgcgattttatgttaatgccacaacatattatggtgaaaacctctacattattggaaatacaacggatttgggagcatggaacttgaacagtgcattacctatgaatgcagggatgtacacgacggaaaaccctgtttggtatgtggatgcgcagttaacggctggggagccagtcagttatgtttatgtgagagaacaagattgcggtcaagctccaatttacgagacgaataatcgaacaagtgtggttccggaatgtggtacaggtgggtcgacgatcaggcgtgatgtatgggtcggtagtggaggaagtagtggagggtgttaa

SEQ ID NO: 487 - protein, 20 aa, Fungi
MRRKSTDKYKKVSIRAHLAA

SEQ ID NO: 488 - protein, 83 aa, Fungi
CEQLAISKMLFSRTATILSLLCVQATAISPRGSAASYSSLDSFIASERKIALQGVLNNIGPDGSKASGAGNYVIASPSKTNPD

SEQ ID NO: 489 - protein, 72 aa, Fungi
YFYTWTRDSALTLKMLVDEFIFGNRALQPQIEKYVKAQAILQTVTNPSGTFLPNGLGLGEPKYEVDGTRFNG

SEQ ID NO: 490 - protein, 200 aa, Fungi
AWGRPQRDGPALRAIALMAYSDWLINHNQLQRAKLVIWPIISNDLSYIGEYWNQTGYDLWEEVLGSSFFTVQNQHRAFVEAGNLANRLGVESPGYLNALEALCFLNQSFWNGEYIVSNINVDNGRTGLDGASILGSISIFDIDGSCDSPNLQPCSSRALSNFRAVVNSFRFYSINAGIKNNSGIAVGRYAEDIYQGGNPW

SEQ ID NO: 491 - protein, 268 aa, Fungi
YLLTTAAAEFLYDAVAQWRNQKKLTVDSTSINFFRDLYPSIKLKSYTNRDNEFNKILNVVTKYADSFVAIAQKYTPSSGSLAEQFDRNTGAPISANDLTWSYAAFVTMAQRRSGQYPASWGSAAASVPPPNCASSSSQGVYVPAIAAGAPNVTATCQYPVRFYVNATTYYGENLYIIGNTTDLGAWNLNSALPMNAGMYTTENPVWYVDAQLTAGEPVSYVYVREQDCGQAPIYETNNRTSVVPECGTGGSTIRRDVWVGSGGSSGGC

SEQ ID NO: 492 - DNA, 1932 bp, Fungi
atgagacgaaaaagtacagacaagtacaagaaagtatcaataagagctcatcttgctgcatgtgaacaattggcaatatccaagatgctgttttctcgaactgccacgattttgtctctgctatgtgtacaagcaactgcaatttcaccgagaggttcggccgcaagttatagtagtcttgattccttcattgcttccgagagaaagattgctctgcagggtgttctcaacaatattggaccagacggatcgaaagcatcaggagcaggcaattatgtcattgcaagtccttccaagaccaatcctgattacttctatacctggactcgagattctgcgttaacgttaaaaatgcttgttgatgaatttatttttggcaatcgtgcactccagcctcagattgagaaatacgtgaaagctcaagccatccttcaaactgttacgaatccttctggcactttccttcctaacggtttaggacttggtgaacccaaatacgaggttgacggtactcgatttaatggtgcatggggtagacctcagcgcgatggtccagctcttcgtgctatcgcattaatggcctacagcgattggttaattaatcataatcagcttcaaagagccaagctagttatatggcctataatctcaaatgacttatcatacattggcgaatattggaaccaaactggatatgatttatgggaagaagttctaggatctagcttttttaccgtacaaaatcaacaccgtgcttttgttgaagccggaaatctggccaatagactcggtgttgaatctccaggatatcttaatgcattagaagctctatgcttccttaatcaaagtttttggaacggagaatatatcgtttcgaacatcaatgtcgataacggaagaactgggttagacggagcctcaattcttggatctatttctatcttcgatattgatggctcttgcgatagcccaaatttacaaccgtgtagtagcagagcgttgtctaattttagggcagtcgtgaacagcttccgattttatagtatcaatgctggtattaaaaacaattcaggtatcgccgttggaagatatgccgaagacatttatcaaggaggaaatccatggtacttacttaccactgcggccgcagaatttctttatgatgctgttgcacaatggagaaatcagaaaaaacttaccgttgattcaacatccattaatttcttccgcgatctttacccatctatcaaacttaagagttacacaaacagggacaacgaatttaacaagattcttaatgtcgtaacaaaatacgccgactcttttgtcgcaattgctcaaaaatatacacccagtagtggatctttagccgaacaattcgatcgcaatacaggagcccccatttctgccaatgaccttacatggagttatgcggcatttgtcaccatggctcaaagacgttcaggtcaatatcctgctagttggggaagtgcggcagcatcggttccacccccaaattgcgcatcttcatcttctcaaggagtgtatgttccagccattgcagcaggggccccaaatgtaacggcaacatgtcaatatccagtgcgattttatgttaatgccacaacatattatggtgaaaacctctacattattggaaatacaacggatttgggagcatggaacttgaacagtgcattacctatgaatgcagggatgtacacgacggaaaaccctgtttggtatgtggatgcgcagttaacggctggggagccagtcagttatgtttatgtgagagaacaagattgcggtcaagctccaatttacgagacgaataatcgaacaagtgtggttccggaatgtggtacaggtgggtcgacgatcaggcgtgatgtatgggtcggtagtggaggaagtagtggagggtgttaa

SEQ ID NO: 493 - protein, 643 aa, Fungi
  DOMAIN (532)...(628): Starch binding domain
  DOMAIN (69)...(485): Glycosyl hydrolases family 15
  SIGNAL (1)...(54)
MRRKSTDKYKKVSIRAHLAACEQLAISKMLFSRTATILSLLCVQATAISPRGSAASYSSLDSFIASERKIALQGVLNNIGPDGSKASGAGNYVIASPSKTNPDYFYTWTRDSALTLKMLVDEFIFGNRALQPQIEKYVKAQAILQTVTNPSGTFLPNGLGLGEPKYEVDGTRFNGAWGRPQRDGPALRAIALMAYSDWLINHNQLQRAKLVIWPIISNDLSYIGEYWNQTGYDLWEEVLGSSFFTVQNQHRAFVEAGNLANRLGVESPGYLNALEALCFLNQSFWNGEYIVSNINVDNGRTGLDGASILGSISIFDIDGSCDSPNLQPCSSRALSNFRAVVNSFRFYSINAGIKNNSGIAVGRYAEDIYQGGNPWYLLTTAAAEFLYDAVAQWRNQKKLTVDSTSINFFRDLYPSIKLKSYTNRDNEFNKILNVVTKYADSFVAIAQKYTPSSGSLAEQFDRNTGAPISANDLTWSYAAFVTMAQRRSGQYPASWGSAAASVPPPNCASSSSQGVYVPAIAAGAPNVTATCQYPVRFYVNATTYYGENLYIIGNTTDLGAWNLNSALPMNAGMYTTENPVWYVDAQLTAGEPVSYVYVREQDCGQAPIYETNNRTSVVPECGTGGSTIRRDVWVGSGGSSGGC

SEQ ID NO: 494 - DNA, 1586 bp, Fungi
  CDS (1)...(225): Exon
  CDS (283)...(450): Exon
  CDS (501)...(1586): Exon
atgggattttcgaaaatgttgttgggcgccttgataggcatcgcttcgttaaacggcgttcaatcagcaacgcccgacgaatggaggactcgttcaatatatcaagtatttacagatcgatttgcaagaacagatgtttcaaatactacggattgcccttctcaaactcggggatactgtggtgggacatggcaaggcataattaacaagctcgattatatccaggtatgagagtagtgcaatcacatattggtaaaattacaagtgctaataggctattaggatatggggttcacagcaatttggatatcaccagttgttgaacaagttggggatccaggtcgcggctttcatgggtattcggctcagaatttgtatggtctaaacagtcacttcggagacgcagcggatttgaaagcgctagctaccgcgctccatgatcgaggaatggtgagactgaacaagaaatttgcacagataaagaaagctaattctggtagtatttgatggttgatgtcgtggcgaaccatatgggatctgatgatactgcgcataacgttgatttcagcatcatgaatccattcaatgacagcaaatactttcacagtgtctgctttatcaatgattacaacaatcagacaaatgttgaactatgcgagcttggaacggagcggtatccattacctgatctaaacactactcgacaagatgttcgagatctccatactacttggatcaagtcactagtagccaactactcaattgacggattgagagtggacactgttagacatgtagagaaggatttttggcctttattcaatgaaaccgccggtgtttattgtgttggcgaagtggcagatggagacgtagattatctatgtccctaccaagattacatagatgggcttctctcctatgcctcatacttccaactcacaaaattcttttccaacacctctgcaacatcagagaacttaataggacaattacaatcccagaattatcaatgtaaagacacgacacttctgggatccttcaccgagaaccatgatcaaccgcgcttcggaaattacactagtgacctcacgttagctaaaaacatcatcacatatacgatgttagcagatggtataccaattatctatcaagggcaagaacagcatttccatggcgcaactgacccttatgatcgtgaacccatatggcctacaggttacgatactacttccccactttatgtcctggtcaaacaattgaacgctatacgttctttggcgatagcacgctcggatacatatgctacttatcaaacccaaatcgcttactcagatccgcacaatattgcgtttcggaggggagatgagaaatgcatgagtctaatggtgctgaacaatatcggtgagagtgcagaggattatacagtcgagattgagaatgtggggtttgaagctggatcgatagtgacggatgtattgagttgtagaaatgtaatggtagatgagtatggtgggatggaagtgccatttgtgagcgggttacctagtgtaagtctaatcctctccatgagactgtttaaaatctaa

SEQ ID NO: 495 - protein, 75 aa, Fungi
MGFSKMLLGALIGIASLNGVQSATPDEWRTRSIYQVFTDRFARTDVSNTTDCPSQTRGYCGGTWQGIINKLDYIQ

SEQ ID NO: 496 - protein, 56 aa, Fungi
DMGFTAIWISPVVEQVGDPGRGFHGYSAQNLYGLNSHFGDAADLKALATALHDRGM

SEQ ID NO: 497 - protein, 361 aa, Fungi
YLMVDVVANHMGSDDTAHNVDFSIMNPFNDSKYFHSVCFINDYNNQTNVELCELGTERYPLPDLNTTRQDVRDLHTTWIKSLVANYSIDGLRVDTVRHVEKDFWPLFNETAGVYCVGEVADGDVDYLCPYQDYIDGLLSYASYFQLTKFFSNTSATSENLIGQLQSQNYQCKDTTLLGSFTENHDQPRFGNYTSDLTLAKNIITYTMLADGIPIIYQGQEQHFHGATDPYDREPIWPTGYDTTSPLYVLVKQLNAIRSLAIARSDTYATYQTQIAYSDPHNIAFRRGDEKCMSLMVLNNIGESAEDYTVEIENVGFEAGSIVTDVLSCRNVMVDEYGGMEVPFVSGLPSVSLILSMRLFKI

SEQ ID NO: 498 - DNA, 1479 bp, Fungi
atgggattttcgaaaatgttgttgggcgccttgataggcatcgcttcgttaaacggcgttcaatcagcaacgcccgacgaatggaggactcgttcaatatatcaagtatttacagatcgatttgcaagaacagatgtttcaaatactacggattgcccttctcaaactcggggatactgtggtgggacatggcaaggcataattaacaagctcgattatatccaggatatggggttcacagcaatttggatatcaccagttgttgaacaagttggggatccaggtcgcggctttcatgggtattcggctcagaatttgtatggtctaaacagtcacttcggagacgcagcggatttgaaagcgctagctaccgcgctccatgatcgaggaatgtatttgatggttgatgtcgtggcgaaccatatgggatctgatgatactgcgcataacgttgatttcagcatcatgaatccattcaatgacagcaaatactttcacagtgtctgctttatcaatgattacaacaatcagacaaatgttgaactatgcgagcttggaacggagcggtatccattacctgatctaaacactactcgacaagatgttcgagatctccatactacttggatcaagtcactagtagccaactactcaattgacggattgagagtggacactgttagacatgtagagaaggatttttggcctttattcaatgaaaccgccggtgtttattgtgttggcgaagtggcagatggagacgtagattatctatgtccctaccaagattacatagatgggcttctctcctatgcctcatacttccaactcacaaaattcttttccaacacctctgcaacatcagagaacttaataggacaattacaatcccagaattatcaatgtaaagacacgacacttctgggatccttcaccgagaaccatgatcaaccgcgcttcggaaattacactagtgacctcacgttagctaaaaacatcatcacatatacgatgttagcagatggtataccaattatctatcaagggcaagaacagcatttccatggcgcaactgacccttatgatcgtgaacccatatggcctacaggttacgatactacttccccactttatgtcctggtcaaacaattgaacgctatacgttctttggcgatagcacgctcggatacatatgctacttatcaaacccaaatcgcttactcagatccgcacaatattgcgtttcggaggggagatgagaaatgcatgagtctaatggtgctgaacaatatcggtgagagtgcagaggattatacagtcgagattgagaatgtggggtttgaagctggatcgatagtgacggatgtattgagttgtagaaatgtaatggtagatgagtatggtgggatggaagtgccatttgtgagcgggttacctagtgtaagtctaatcctctccatgagactgtttaaaatctaa

SEQ ID NO: 499 - protein, 492 aa, Fungi
  SIGNAL (1)...(22)
  DOMAIN (35)...(388): Alpha amylase, catalytic domain
MGFSKMLLGALIGIASLNGVQSATPDEWRTRSIYQVFTDRFARTDVSNTTDCPSQTRGYCGGTWQGIINKLDYIQDMGFTAIWISPVVEQVGDPGRGFHGYSAQNLYGLNSHFGDAADLKALATALHDRGMYLMVDVVANHMGSDDTAHNVDFSIMNPFNDSKYFHSVCFINDYNNQTNVELCELGTERYPLPDLNTTRQDVRDLHTTWIKSLVANYSIDGLRVDTVRHVEKDFWPLFNETAGVYCVGEVADGDVDYLCPYQDYIDGLLSYASYFQLTKFFSNTSATSENLIGQLQSQNYQCKDTTLLGSFTENHDQPRFGNYTSDLTLAKNIITYTMLADGIPIIYQGQEQHFHGATDPYDREPIWPTGYDTTSPLYVLVKQLNAIRSLAIARSDTYATYQTQIAYSDPHNIAFRRGDEKCMSLMVLNNIGESAEDYTVEIENVGFEAGSIVTDVLSCRNVMVDEYGGMEVPFVSGLPSVSLILSMRLFKI

SEQ ID NO: 500 - DNA, 2236 bp, Fungi
  CDS (1)...(63): Exon
  CDS (114)...(207): Exon
  CDS (264)...(287): Exon
  CDS (341)...(378): Exon
  CDS (435)...(560): Exon
  CDS (623)...(1521): Exon
  CDS (1571)...(1973): Exon
  CDS (2051)...(2236): Exon
atgagtcaagtttctggaaaagtgcccgacaggaagtggtggaaggaagctattgtctaccaggtttgaactacttttctcttgtcactgcatgcgacttatacggcggctagatctatcccgcgtcgtttcttgataccgattctaatggcgtcgggaacatcaatgggatcacagctaagctggactacctcaaggaattgggcggtaagaactgacctccctcctcctatgctcatgatctaacgcgtgtgtgttcacagtggacattctctggatttcacccggtaagctctatcccagccgtagcgacgcgcttccagtctaacacgcgctctagtttacgaaagcccccagaaggacatgggatacgacattgtacgacacccatctctttataaaaattgatgtagcacccactgaccttgtcgcagtcgaattaccgcgatatccatcgcccctacggcaccatgcaagacgtgcaccacttgatcaacgagctcaaagcacgcgacatgaaactgatcatggatctggtggtcaatcacacctcgaccgaggtaagatagcctttcgaactctgtatcctgtttaacgtgactgatttcacctgacgctatagcatccctggttcatcgactcagcctcgtccgcagtaagcgcgcgacgagactggtacatctggcgcaagccaaagtacgacgagcagggcaatcggcagccaccgaataactggtgcagcctctttgacgagactgaatcagcctggacctacgacgctaagacggatgagtactatctctcgctgtttagtccgttccaggcagatcttaactgggagaccccattcgtcagagaggaagtctgcgacatcctgcgcttctggctcgacaagggcgtctctggtttccggatggacgtcatcaacctcatctccaaggaccagaggttccctgacgcagagatccgccacccgggcaggaagtaccagccgggtgaatgctacttcgccaacggggtccgactcatggactatctccaggagatgaagaccgccgtattctcaaagtatgacgccgtcacggtcggcgagatgccgtaccttgaagatgaagagcagagactcaggatggtcgcggctgaagaaggcgtgctgaacatgatcttcacttttgagatgattggcctcgacatcgtccccgaaaaaggccgcttcagcaataaagcttggaaggtctgtgagctgaaggacatagttgccaaggcctgcaagctcgttaaccaggacgggtggcatacgctcttctgcgagaatcatgaccagccgcgttccgtcacgcgtttctgcgacgactcggatgagcatcgtgtcgcaggcaccaagctcctctccatcatgcagacaagccttcctggtaccctgtatgtctaccagggcgaagagctgggtatgcgaaacgtgcccaagtcctggggatttgaagaatacatagacattgagtctgtctcctacatcaagaagtaagtctcaattctcttatcgactttaacatctactgacatggtatagtgtctgcgctcaattcccagaagggtctccggaaagaaaagaggctaagaatcttctgcgcctcaaagctcgtgataatgccaggaccccaatgcagtgggactctacatctaacggcggcttctgtcccgagggagtcaagccctggatgcgcgtcaacgacgactacacgatggtcaacgcagctctacagacttccgcaggccaggcaaccgaccgcaccatgcttgtgtcaccctataggttctggcagcgaagcatccagatacgcaagaagttcaaagacctgctcgtgtacggagaccttgagattattgatggcacgcacgccaacgtctttgcgttcaagaggatcagcaacggcagacataccatcacgatccttaactttagtaaggaggaggtgagtttcaagtttccggaaggtgagggggtcaggggctgggctctcgggagttatgatgttttgtctttggcgaggccgtggacgggggagatacagcttttaccttgggagggcttgcttggtattgcttgatggatctctcattttggaatggaagtaaaagattggtatcaatggctacgatattgtctttatatagccagtacagaatgccacggactgttagtaacatgcaatgtcttgtgataccatccagttaa

SEQ ID NO: 501 - protein, 21 aa, Fungi
MSQVSGKVPDRKWWKEAIVYQ

SEQ ID NO: 502 - protein, 31 aa, Fungi
IYPASFLDTDSNGVGNINGITAKLDYLKELG

SEQ ID NO: 503 - protein, 8 aa, Fungi
VDILWISP

SEQ ID NO: 504 - protein, 13 aa, Fungi
VYESPQKDMGYDI

SEQ ID NO: 505 - protein, 42 aa, Fungi
SNYRDIHRPYGTMQDVHHLINELKARDMKLIMDLVVNHTSTE

SEQ ID NO: 506 - protein, 300 aa, Fungi
HPWFIDSASSAVSARRDWYIWRKPKYDEQGNRQPPNNWCSLFDETESAWTYDAKTDEYYLSLFSPFQADLNWETPFVREEVCDILRFWLDKGVSGFRMDVINLISKDQRFPDAEIRHPGRKYQPGECYFANGVRLMDYLQEMKTAVFSKYDAVTVGEMPYLEDEEQRLRMVAAEEGVLNMIFTFEMIGLDIVPEKGRFSNKAWKVCELKDIVAKACKLVNQDGWHTLFCENHDQPRSVTRFCDDSDEHRVAGTKLLSIMQTSLPGTLYVYQGEELGMRNVPKSWGFEEYIDIESVSYIKN

SEQ ID NO: 507 - protein, 134 aa, Fungi
VCAQFPEGSPERKEAKNLLRLKARDNARTPMQWDSTSNGGFCPEGVKPWMRVNDDYTMVNAALQTSAGQATDRTMLVSPYRFWQRSIQIRKKFKDLLVYGDLEIIDGTHANVFAFKRISNGRHTITILNFSKEE

SEQ ID NO: 508 - protein, 61 aa, Fungi
AVDGGDTAFTLGGLAWYCLMDLSFWNGSKRLVSMATILSLYSQYRMPRTVSNMQCLVIPSS

SEQ ID NO: 509 - DNA, 1833 bp, Fungi
atgagtcaagtttctggaaaagtgcccgacaggaagtggtggaaggaagctattgtctaccagatctatcccgcgtcgtttcttgataccgattctaatggcgtcgggaacatcaatgggatcacagctaagctggactacctcaaggaattgggcgtggacattctctggatttcacccgtttacgaaagcccccagaaggacatgggatacgacatttcgaattaccgcgatatccatcgcccctacggcaccatgcaagacgtgcaccacttgatcaacgagctcaaagcacgcgacatgaaactgatcatggatctggtggtcaatcacacctcgaccgagcatccctggttcatcgactcagcctcgtccgcagtaagcgcgcgacgagactggtacatctggcgcaagccaaagtacgacgagcagggcaatcggcagccaccgaataactggtgcagcctctttgacgagactgaatcagcctggacctacgacgctaagacggatgagtactatctctcgctgtttagtccgttccaggcagatcttaactgggagaccccattcgtcagagaggaagtctgcgacatcctgcgcttctggctcgacaagggcgtctctggtttccggatggacgtcatcaacctcatctccaaggaccagaggttccctgacgcagagatccgccacccgggcaggaagtaccagccgggtgaatgctacttcgccaacggggtccgactcatggactatctccaggagatgaagaccgccgtattctcaaagtatgacgccgtcacggtcggcgagatgccgtaccttgaagatgaagagcagagactcaggatggtcgcggctgaagaaggcgtgctgaacatgatcttcacttttgagatgattggcctcgacatcgtccccgaaaaaggccgcttcagcaataaagcttggaaggtctgtgagctgaaggacatagttgccaaggcctgcaagctcgttaaccaggacgggtggcatacgctcttctgcgagaatcatgaccagccgcgttccgtcacgcgtttctgcgacgactcggatgagcatcgtgtcgcaggcaccaagctcctctccatcatgcagacaagccttcctggtaccctgtatgtctaccagggcgaagagctgggtatgcgaaacgtgcccaagtcctggggatttgaagaatacatagacattgagtctgtctcctacatcaagaatgtctgcgctcaattcccagaagggtctccggaaagaaaagaggctaagaatcttctgcgcctcaaagctcgtgataatgccaggaccccaatgcagtgggactctacatctaacggcggcttctgtcccgagggagtcaagccctggatgcgcgtcaacgacgactacacgatggtcaacgcagctctacagacttccgcaggccaggcaaccgaccgcaccatgcttgtgtcaccctataggttctggcagcgaagcatccagatacgcaagaagttcaaagacctgctcgtgtacggagaccttgagattattgatggcacgcacgccaacgtctttgcgttcaagaggatcagcaacggcagacataccatcacgatccttaactttagtaaggaggaggccgtggacgggggagatacagcttttaccttgggagggcttgcttggtattgcttgatggatctctcattttggaatggaagtaaaagattggtatcaatggctacgatattgtctttatatagccagtacagaatgccacggactgttagtaacatgcaatgtcttgtgataccatccagttaa

SEQ ID NO: 510 - protein, 610 aa, Fungi
  DOMAIN (21)...(443): Alpha amylase, catalytic domain
MSQVSGKVPDRKWWKEAIVYQIYPASFLDTDSNGVGNINGITAKLDYLKELGVDILWISPVYESPQKDMGYDISNYRDIHRPYGTMQDVHHLINELKARDMKLIMDLVVNHTSTEHPWFIDSASSAVSARRDWYIWRKPKYDEQGNRQPPNNWCSLFDETESAWTYDAKTDEYYLSLFSPFQADLNWETPFVREEVCDILRFWLDKGVSGFRMDVINLISKDQRFPDAEIRHPGRKYQPGECYFANGVRLMDYLQEMKTAVFSKYDAVTVGEMPYLEDEEQRLRMVAAEEGVLNMIFTFEMIGLDIVPEKGRFSNKAWKVCELKDIVAKACKLVNQDGWHTLFCENHDQPRSVTRFCDDSDEHRVAGTKLLSIMQTSLPGTLYVYQGEELGMRNVPKSWGFEEYIDIESVSYIKNVCAQFPEGSPERKEAKNLLRLKARDNARTPMQWDSTSNGGFCPEGVKPWMRVNDDYTMVNAALQTSAGQATDRTMLVSPYRFWQRSIQIRKKFKDLLVYGDLEIIDGTHANVFAFKRISNGRHTITILNFSKEEAVDGGDTAFTLGGLAWYCLMDLSFWNGSKRLVSMATILSLYSQYRMPRTVSNMQCLVIPSS

SEQ ID NO: 511 - DNA, 1792 bp, Fungi
  CDS (1)...(300): Exon
  CDS (392)...(1081): Exon
  CDS (1133)...(1792): Exon
atgaagtactcaattattccattcgttccccttttcgcgggtttatctcgagcagcaagtagtgatgactgggcggggaggtctatctatcaggttatcacagatagatatcatcgatcctcagattcggatgctccttgtaatatcacgaattattgtggaggtacctggaatggcatcacggagaatctggattatatccagaatatggggttcacggccattcaaattagtcccgtcaatttgaacattaacagtacgacgatttacggacaagctttccatggatattggcagactgtaggttttctcttggcagagcttccctctatttgcatacaattggcttgttgttggggtagcatgaagagttctaacatcaatactgcagtctctctacgatctcaatccgaacttcggttcagcagatgatttgttgaaactaagtgcagaagttcacaagagaaaaatgtatctcctagttgatgtcgttgctagtgagatggccgttgacattggagatcacaacatgaccgctggaaccaagatcgattattcagctttctcccctgctccattcaacgatgaatcatcatacaacccctactgcccaattatcgattggcaaaatgtcacagaatatcaagattgttggttgggatacaccggagtcgcaactccagatatcaaaacagacaataaagaaatcgcagccgcattaggcacatggattaaggagcttgtctccaattactctattgatggaattcgagtcgatggtgctaaacagattacatatgacttcttccaagatttcgtcgatgccgccggtgtatatcctttgggagaagtagaggatggcgatgctgcctttacttgcaattaccaacagtacaccgagggattggagaactatccggtttattacacaaccattcaagcctttaccgctggaaaaatggctggtctggtcgatatggtcaagagtatgggagctttgtgcaaatctccacaatatctcgcgaatttcattgagaatcaagatcaaccacgttttgcatcttataatgatgatgagactgtaagtttcttctacttcatgttctaatacaaaatcactaacacaaaacagctcgcagccaacgcaatggctttcacaatcctggcagatggtatccccaagtactattacggacaagaacaacatctgcagggcaactactctccatacaaccgtcaagctctctgggaaagtaagccaagcacaactactcctctctacactatgacagctactctcaacaccctccgtaaccacgccatctccataaactcaaactacatcgccaacatgtccattctgctccacaatgacgattccacatacgcaacacgtaaaggaccaaacggtgttcaaatcgtctcggtactttctaaccaaggttccaaaggaggaagctacactctaggcatcaacaatgccgccgacgctggaacaaacatgaccgaagtaatcacatgcacatcgtacattgcaagtgagaacggaacgctcttcattgagatggacaaaggagagccaagagtactgttccctagctaccaaatgaatggaacgggcatttgtggattcgatgaagatgctagtgcgggaacagcaacaagcactggaacggcgactggaagtgcagctagtgcgacatcatcgaagaagggagatgcgagtggattgagagttgccggttgggtgttcgcgggtgcgatgggtgcgtctgctttggctttcatgtag

SEQ ID NO: 512 - protein, 100 aa, Fungi
MKYSIIPFVPLFAGLSRAASSDDWAGRSIYQVITDRYHRSSDSDAPCNITNYCGGTWNGITENLDYIQNMGFTAIQISPVNLNINSTTIYGQAFHGYWQT

SEQ ID NO: 513 - protein, 230 aa, Fungi
SLYDLNPNFGSADDLLKLSAEVHKRKMYLLVDVVASEMAVDIGDHNMTAGTKIDYSAFSPAPFNDESSYNPYCPIIDWQNVTEYQDCWLGYTGVATPDIKTDNKEIAAALGTWIKELVSNYSIDGIRVDGAKQITYDFFQDFVDAAGVYPLGEVEDGDAAFTCNYQQYTEGLENYPVYYTTIQAFTAGKMAGLVDMVKSMGALCKSPQYLANFIENQDQPRFASYNDDET

SEQ ID NO: 514 - protein, 219 aa, Fungi
LAANAMAFTILADGIPKYYYGQEQHLQGNYSPYNRQALWESKPSTTTPLYTMTATLNTLRNHAISINSNYIANMSILLHNDDSTYATRKGPNGVQIVSVLSNQGSKGGSYTLGINNAADAGTNMTEVITCTSYIASENGTLFIEMDKGEPRVLFPSYQMNGTGICGFDEDASAGTATSTGTATGSAASATSSKKGDASGLRVAGWVFAGAMGASALAFM

SEQ ID NO: 515 - DNA, 1650 bp, Fungi
atgaagtactcaattattccattcgttccccttttcgcgggtttatctcgagcagcaagtagtgatgactgggcggggaggtctatctatcaggttatcacagatagatatcatcgatcctcagattcggatgctccttgtaatatcacgaattattgtggaggtacctggaatggcatcacggagaatctggattatatccagaatatggggttcacggccattcaaattagtcccgtcaatttgaacattaacagtacgacgatttacggacaagctttccatggatattggcagacttctctctacgatctcaatccgaacttcggttcagcagatgatttgttgaaactaagtgcagaagttcacaagagaaaaatgtatctcctagttgatgtcgttgctagtgagatggccgttgacattggagatcacaacatgaccgctggaaccaagatcgattattcagctttctcccctgctccattcaacgatgaatcatcatacaacccctactgcccaattatcgattggcaaaatgtcacagaatatcaagattgttggttgggatacaccggagtcgcaactccagatatcaaaacagacaataaagaaatcgcagccgcattaggcacatggattaaggagcttgtctccaattactctattgatggaattcgagtcgatggtgctaaacagattacatatgacttcttccaagatttcgtcgatgccgccggtgtatatcctttgggagaagtagaggatggcgatgctgcctttacttgcaattaccaacagtacaccgagggattggagaactatccggtttattacacaaccattcaagcctttaccgctggaaaaatggctggtctggtcgatatggtcaagagtatgggagctttgtgcaaatctccacaatatctcgcgaatttcattgagaatcaagatcaaccacgttttgcatcttataatgatgatgagactctcgcagccaacgcaatggctttcacaatcctggcagatggtatccccaagtactattacggacaagaacaacatctgcagggcaactactctccatacaaccgtcaagctctctgggaaagtaagccaagcacaactactcctctctacactatgacagctactctcaacaccctccgtaaccacgccatctccataaactcaaactacatcgccaacatgtccattctgctccacaatgacgattccacatacgcaacacgtaaaggaccaaacggtgttcaaatcgtctcggtactttctaaccaaggttccaaaggaggaagctacactctaggcatcaacaatgccgccgacgctggaacaaacatgaccgaagtaatcacatgcacatcgtacattgcaagtgagaacggaacgctcttcattgagatggacaaaggagagccaagagtactgttccctagctaccaaatgaatggaacgggcatttgtggattcgatgaagatgctagtgcgggaacagcaacaagcactggaacggcgactggaagtgcagctagtgcgacatcatcgaagaagggagatgcgagtggattgagagttgccggttgggtgttcgcgggtgcgatgggtgcgtctgctttggctttcatgtag

SEQ ID NO: 516 - protein, 549 aa, Fungi
  SIGNAL (1)...(21)
  DOMAIN (31)...(390): Alpha amylase, catalytic domain
MKYSIIPFVPLFAGLSRAASSDDWAGRSIYQVITDRYHRSSDSDAPCNITNYCGGTWNGITENLDYIQNMGFTAIQISPVNLNINSTTIYGQAFHGYWQTSLYDLNPNFGSADDLLKLSAEVHKRKMYLLVDVVASEMAVDIGDHNMTAGTKIDYSAFSPAPFNDESSYNPYCPIIDWQNVTEYQDCWLGYTGVATPDIKTDNKEIAAALGTWIKELVSNYSIDGIRVDGAKQITYDFFQDFVDAAGVYPLGEVEDGDAAFTCNYQQYTEGLENYPVYYTTIQAFTAGKMAGLVDMVKSMGALCKSPQYLANFIENQDQPRFASYNDDETLAANAMAFTILADGIPKYYYGQEQHLQGNYSPYNRQALWESKPSTTTPLYTMTATLNTLRNHAISINSNYIANMSILLHNDDSTYATRKGPNGVQIVSVLSNQGSKGGSYTLGINNAADAGTNMTEVITCTSYIASENGTLFIEMDKGEPRVLFPSYQMNGTGICGFDEDASAGTATSTGTATGSAASATSSKKGDASGLRVAGWVFAGAMGASALAFM

SEQ ID NO: 517 - DNA, 1758 bp, Fungi
  CDS (1)...(1758): Exon
atgaatatgaacattttccttttgatcatctctctcgcttttttctccaccgtcaattgttacaccatgtccaatgccgaggcctggaaaaggcgttccatataccaagtgctcaccgacagatttgccatagaagatgagaataatcctagtagaggcccagatcatgggatgagagagtattgtggtgggacatggagggggataatatctaaacttgattatattcaaggaatgggttttgatgcagtttggatttcgcccgtttgtttcttcagcctcaccagcgttttgattgcatttactcacaattccatacagatcaccaagaacatcgaagaattgactgaatatggaactgcctatcacggttattggccagaggatatttattcggtaaatccacattttggaaccgctgatgatttgctcgctctatcggatgccttgcacgctcggggtatgtttttgatggttgatatagttgtcaatcatatgggttcgcctcctacagtggactattctagatacgtacctttcaatgattcgtcatactatcatccacagtcattcgtcacgaactacgaaaatcagcaggagaccgaggaaggatggttgggggatgaacatgtgccattacccgatctaaatacggaggatcctactgtggtactcaccctccaaacctggatcacaaaacttgtacagaggttcaaaatcgatggtttgagaattgacaccttcaaacatgtcaggaagaatttttggccggatttcgttcgggctgcgggggtctggtcggtgggtgaggtgttgtcaggtgaccccgactacttgagctcatatcaaccttatgttggaggccttctagactatggaacatattatcctttgaagagagcctttcatagggacggtggaagtatgtatgagttgaccaacctcctcactcctcaatatcgatcaaaattccgcgacatgcagcaaatgtcgacttttatggagaatcatgatatgccgcggtttaccaacgacaccaacgcggatttggctgttgtaaagaatgctatggcatggaatctactcaccgatggtgtgccaattatttactatggacaagaacaatcttattctggagatggtgatcctggctcacgagagctgatgtggacatccaattataacatcacacctctataccaatatatcgcacgtttgaatcagatcagaaagctgggttgggatgtaggatttggtacacatctaaccacacgtctttacgttgaggatcatgtcgctgttacgcagaagggccccgtgctcatggtgctgaccaacctaggtagccaggccagatccaaaactatctctacacctaccatgttcaaaaacggtaccataatagtcgacattctcacaggagaatccttcagagtcaaacgatcgacaaacatcaccatagtatctggagaacctcgaatttttcttcctcttggtctagcagagaatatctgtgaacagatcttaccaccagcgcagagtgccatatccaaactattatctagaatgtttggtgcctcctcttccttgaaaactgccgccgaaatcaccgattggccatatggtgaaccggtcaacagctcagatattatactcgaagaaaaagatccagtcgcggagcaggcaggagccaagacattgatgccgagcgttcaagagagttcatccccgtggtctatattctatacggccagataa

SEQ ID NO: 518 - protein, 585 aa, Fungi
  DOMAIN (36)...(410): Alpha amylase, catalytic domain
  SIGNAL (1)...(26)
MNMNIFLLIISLAFFSTVNCYTMSNAEAWKRRSIYQVLTDRFAIEDENNPSRGPDHGMREYCGGTWRGIISKLDYIQGMGFDAVWISPVCFFSLTSVLIAFTHNSIQITKNIEELTEYGTAYHGYWPEDIYSVNPHFGTADDLLALSDALHARGMFLMVDIVVNHMGSPPTVDYSRYVPFNDSSYYHPQSFVTNYENQQETEEGWLGDEHVPLPDLNTEDPTVVLTLQTWITKLVQRFKIDGLRIDTFKHVRKNFWPDFVRAAGVWSVGEVLSGDPDYLSSYQPYVGGLLDYGTYYPLKRAFHRDGGSMYELTNLLTPQYRSKFRDMQQMSTFMENHDMPRFTNDTNADLAVVKNAMAWNLLTDGVPIIYYGQEQSYSGDGDPGSRELMWTSNYNITPLYQYIARLNQIRKLGWDVGFGTHLTTRLYVEDHVAVTQKGPVLMVLTNLGSQARSKTISTPTMFKNGTIIVDILTGESFRVKRSTNITIVSGEPRIFLPLGLAENICEQILPPAQSAISKLLSRMFGASSSLKTAAEITDWPYGEPVNSSDIILEEKDPVAEQAGAKTLMPSVQESSSPWSIFYTAR

SEQ ID NO: 519 - DNA, 1843 bp, Fungi
  CDS (1)...(887): Exon
  CDS (943)...(1843): Exon
atgcagcctgtcatcccaaacgtcgagcgagcctcgtggcgggaagcctctgtatatcagatctacccaccttcttttaaagataccaatggggatggtataggagatattcaaggaattatctcagagcttgactatatcaagtctcttggcgttgatatggtatggctgtctcccattttggcatctccgcaggttgatatgggttacgatatctctgactataagaatatctatccgccttatggtaccatggccgatcatgatgctttaatcaaaggcctccatgaccgcggtttgaagtatatccttgaccttgttgtgaaccatacatcggatcaacatccttggttcaaagagtccaagtcttcaaagacaagcagatatcgcgactggtatttctggcggccggctcgctgggatcccgaaaccggtaaacggatgccacctaacaattgggaatccttttttagtacaagcgcttggacttgggacgctaccacacaagaatattatcttcacctttggtcatctggacagcctgacttgaactgggaaaatcccgatgtcgtcaatgctgtgcacgatatcgtaagattctggcttgatcgtggcgttgatgggtttcgaatggatgtcattaactatatttcgaaaacacctggcctgcccgacgcaaagatcaagaaaccgggattttttcagaagcccaccgagcattgtgcttgtggaccacggctgcacgaatacctacgtgggattggatcgatactccaggaatacgatgcatttagtgtcggcgagatgccagatgcagatcccgaagaagttctcaaagctgtgggccaggatcgtggagaattagctatggcgtttcactttgacatgtaagtcataacagaatatagtcttttacaggatctcgggctaacaattacacagagatgggcttgacctaggtgcaaatcatagatttgaccccgccgtgttccaaccaacagcattaaagaacgtagtcaacaaatggcaaacattcatggcatccaacgcaggttggaacgccctgcatatggagaaccacgacgagagccgaacagttagtcgttacgcttgcgactctcccgccatgcgaacaatatcagccaagatgctagcaaaccaccttgccttccagtctggaacacttttcatctatcagggacaggaacttgcaatggttaatcttccccgagaatggggaatggagaaatacaaagacatcgaatgtctgaatcactgggagttggtacagcgttgttaccacgacgatgtaaaaaagcagaagatgtatagggacagataccgacaggtcggacgtgacaacgctcgcacgcccatgcagtggaactcggagagtccatatgctggattcgtgccgattggttctaagcaagttgagccctggatgtctatccaccctgactttgggacttggaacgtttccacgatgttagccgattcgcagtccagccttcaccattggcgccgggtgctcaagtttcgaaagcagcattccaacatatttgtttacggaggattcgaaatgctaaatatagaaatcgaagaagacgtcattgcgtatatacgcactgacaacactactggtgggagcctaactggaccgacggaggcgctggttgtgaccagttttagtgccactgatatctggtggaccattcctcccaaggcaatgactattctactcggtgcgtccacagattcaagaaagcccaatatcaatgtgacggggatggtaaccgctttgggcaattatgagggtgtgaacgaattgatggtcaattag

SEQ ID NO: 520 - protein, 296 aa, Fungi
MQPVIPNVERASWREASVYQIYPPSFKDTNGDGIGDIQGIISELDYIKSLGVDMVWLSPILASPQVDMGYDISDYKNIYPPYGTMADHDALIKGLHDRGLKYILDLVVNHTSDQHPWFKESKSSKTSRYRDWYFWRPARWDPETGKRMPPNNWESFFSTSAWTWDATTQEYYLHLWSSGQPDLNWENPDVVNAVHDIVRFWLDRGVDGFRMDVINYISKTPGLPDAKIKKPGFFQKPTEHCACGPRLHEYLRGIGSILQEYDAFSVGEMPDADPEEVLKAVGQDRGELAMAFHFDI

SEQ ID NO: 521 - protein, 299 aa, Fungi
DGLDLGANHRFDPAVFQPTALKNVVNKWQTFMASNAGWNALHMENHDESRTVSRYACDSPAMRTISAKMLANHLAFQSGTLFIYQGQELAMVNLPREWGMEKYKDIECLNHWELVQRCYHDDVKKQKMYRDRYRQVGRDNARTPMQWNSESPYAGFVPIGSKQVEPWMSIHPDFGTWNVSTMLADSQSSLHHWRRVLKFRKQHSNIFVYGGFEMLNIEIEEDVIAYIRTDNTTGGSLTGPTEALVVTSFSATDIWWTIPPKAMTILLGASTDSRKPNINVTGMVTALGNYEGVNELMVN

SEQ ID NO: 522 - DNA, 1788 bp, Fungi
atgcagcctgtcatcccaaacgtcgagcgagcctcgtggcgggaagcctctgtatatcagatctacccaccttcttttaaagataccaatggggatggtataggagatattcaaggaattatctcagagcttgactatatcaagtctcttggcgttgatatggtatggctgtctcccattttggcatctccgcaggttgatatgggttacgatatctctgactataagaatatctatccgccttatggtaccatggccgatcatgatgctttaatcaaaggcctccatgaccgcggtttgaagtatatccttgaccttgttgtgaaccatacatcggatcaacatccttggttcaaagagtccaagtcttcaaagacaagcagatatcgcgactggtatttctggcggccggctcgctgggatcccgaaaccggtaaacggatgccacctaacaattgggaatccttttttagtacaagcgcttggacttgggacgctaccacacaagaatattatcttcacctttggtcatctggacagcctgacttgaactgggaaaatcccgatgtcgtcaatgctgtgcacgatatcgtaagattctggcttgatcgtggcgttgatgggtttcgaatggatgtcattaactatatttcgaaaacacctggcctgcccgacgcaaagatcaagaaaccgggattttttcagaagcccaccgagcattgtgcttgtggaccacggctgcacgaatacctacgtgggattggatcgatactccaggaatacgatgcatttagtgtcggcgagatgccagatgcagatcccgaagaagttctcaaagctgtgggccaggatcgtggagaattagctatggcgtttcactttgacatagatgggcttgacctaggtgcaaatcatagatttgaccccgccgtgttccaaccaacagcattaaagaacgtagtcaacaaatggcaaacattcatggcatccaacgcaggttggaacgccctgcatatggagaaccacgacgagagccgaacagttagtcgttacgcttgcgactctcccgccatgcgaacaatatcagccaagatgctagcaaaccaccttgccttccagtctggaacacttttcatctatcagggacaggaacttgcaatggttaatcttccccgagaatggggaatggagaaatacaaagacatcgaatgtctgaatcactgggagttggtacagcgttgttaccacgacgatgtaaaaaagcagaagatgtatagggacagataccgacaggtcggacgtgacaacgctcgcacgcccatgcagtggaactcggagagtccatatgctggattcgtgccgattggttctaagcaagttgagccctggatgtctatccaccctgactttgggacttggaacgtttccacgatgttagccgattcgcagtccagccttcaccattggcgccgggtgctcaagtttcgaaagcagcattccaacatatttgtttacggaggattcgaaatgctaaatatagaaatcgaagaagacgtcattgcgtatatacgcactgacaacactactggtgggagcctaactggaccgacggaggcgctggttgtgaccagttttagtgccactgatatctggtggaccattcctcccaaggcaatgactattctactcggtgcgtccacagattcaagaaagcccaatatcaatgtgacggggatggtaaccgctttgggcaattatgagggtgtgaacgaattgatggtcaattag

SEQ ID NO: 523 - protein, 595 aa, Fungi
  DOMAIN (20)...(430): Alpha amylase, catalytic domain
MQPVIPNVERASWREASVYQIYPPSFKDTNGDGIGDIQGIISELDYIKSLGVDMVWLSPILASPQVDMGYDISDYKNIYPPYGTMADHDALIKGLHDRGLKYILDLVVNHTSDQHPWFKESKSSKTSRYRDWYFWRPARWDPETGKRMPPNNWESFFSTSAWTWDATTQEYYLHLWSSGQPDLNWENPDVVNAVHDIVRFWLDRGVDGFRMDVINYISKTPGLPDAKIKKPGFFQKPTEHCACGPRLHEYLRGIGSILQEYDAFSVGEMPDADPEEVLKAVGQDRGELAMAFHFDIDGLDLGANHRFDPAVFQPTALKNVVNKWQTFMASNAGWNALHMENHDESRTVSRYACDSPAMRTISAKMLANHLAFQSGTLFIYQGQELAMVNLPREWGMEKYKDIECLNHWELVQRCYHDDVKKQKMYRDRYRQVGRDNARTPMQWNSESPYAGFVPIGSKQVEPWMSIHPDFGTWNVSTMLADSQSSLHHWRRVLKFRKQHSNIFVYGGFEMLNIEIEEDVIAYIRTDNTTGGSLTGPTEALVVTSFSATDIWWTIPPKAMTILLGASTDSRKPNINVTGMVTALGNYEGVNELMVN

SEQ ID NO: 524 - DNA, 1820 bp, Fungi
  CDS (1)...(277): Exon
  CDS (343)...(1820): Exon
  misc_feature (791)...(800): n = a, g, c or t
atgggatcaatagccagaagaaccattggttcaactcctcaatggtggaaagaagcagtcgtatatcaaatctatcccgcttcgtatctcgacaccaccggatctggagatggtgatctcaatggtatcacctcgaaattgccatatatcagatctctcggtgtagatgtagtatggatttcacctatctatgcatcccctatgaatgatatgggctatgatatttcggattatcgagctatcaaccctatgtttggtactatggaagattgggaacgtgagtcacctcttcctcattcttttctcaaagctctcaaaaaaaaaaaaattaacagcgcctaggtctttgcgccagagcacacgaactaggtttgaaactcgtgatggatctcgtggtaaatcacactagttctgaacacccctggttcaaagaatccgtctccggcggtcccaacggtcctaaaagagacttctactactggcaaccgcccaaaaatggtaaagagcccaataactggggtgccatgtttggaggttcatcctgggaaaaagatccttcgcatcaaacagacgaatactatctccacgtctacgacgtcagccagcccgatcttaattggacaaatccagccgttcgcaacgaggtctgggatatcatgcgcttttggcttgataagggatgtgatgggtttcgtatggatgtcatcaattgcatttcaaaagaacctggatttcccgattttgaagtcaccgatccgagactcgaattccagattggtgtgaggggaaannnnnnnnnncacgtcaaagagtacttggaagaaatgcatcgcgaagttctctgtcattatcccgaagcatttacagtgggagaaaccccaggactcaagagacccgagagtgcattgggcctggtccaaggaggaaaacctcttcaaatgatcttccaattcgagcatatgtacttcgacatccaacccggaatgaaacccttcttccctcgtccttcatggaatcttaccgagatcaagaaaaatctcggggagtggatgtctttcaatgcggcgcatgacggctgggactctctctacctagaaaatcacgatcaaccccgtattcttgggcgctgggcaaaagatactccggaatggagagtgcaagctgcaaaaatgctagcgttatttcatgcaaccggcagaggaaccctatttgtctatcaaggacaagaaatcggaacggcaaacagcaagtggtggaccaatgaagagttcagagatgtagaagagatcaatttctttgcggccgagaaggaacgtcgggagaaagaatcgaatgggaaagaagtagacatgactgatatctcccgaggaatccaaggctacggaagagacaattcgagaatggggatgcaatgggacgactctccaaatggcggtttcacacaaggtaaaccgtggatcaagacgaatgaggagtacaaggaaatcaacgtcgcagcgcaagatggagtcaagggaagcacattagagttctggaaacagataattaaactccggaaagagaatccggtgttgtgtaaagggggatttgaaatggtggatcaggagaacgaggaggtttatgcgtatgtgagaaagggcgaggagaaggagtatttgattgcttgcaatttcaaggagcgggatgtgaaatggaagattccggttgagactggggagcttttgtttggaagctatgaggacggagtacagggtggagagaaggagggagaattaaacttgagaccgttcgagggaagaatatatgttagagatatttga

SEQ ID NO: 525 - protein, 92 aa, Fungi
MGSIARRTIGSTPQWWKEAVVYQIYPASYLDTTGSGDGDLNGITSKLPYIRSLGVDVVWISPIYASPMNDMGYDISDYRAINPMFGTMEDWE

SEQ ID NO: 526 - protein, 492 aa, Fungi
  UNSURE (150)...(154): Xaa = any amino acid
RLCARAHELGLKLVMDLVVNHTSSEHPWFKESVSGGPNGPKRDFYYWQPPKNGKEPNNWGAMFGGSSWEKDPSHQTDEYYLHVYDVSQPDLNWTNPAVRNEVWDIMRFWLDKGCDGFRMDVINCISKEPGFPDFEVTDPRLEFQIGVRGXXXXHVKEYLEEMHREVLCHYPEAFTVGETPGLKRPESALGLVQGGKPLQMIFQFEHMYFDIQPGMKPFFPRPSWNLTEIKKNLGEWMSFNAAHDGWDSLYLENHDQPRILGRWAKDTPEWRVQAAKMLALFHATGRGTLFVYQGQEIGTANSKWWTNEEFRDVEEINFFAAEKERREKESNGKEVDMTDISRGIQGYGRDNSRMGMQWDDSPNGGFTQGKPWIKTNEEYKEINVAAQDGVKGSTLEFWKQIIKLRKENPVLCKGGFEMVDQENEEVYAYVRKGEEKEYLIACNFKERDVKWKIPVETGELLFGSYEDGVQGGEKEGELNLRPFEGRIYVRDI

SEQ ID NO: 527 - DNA, 1755 bp, Fungi
  misc_feature (726)...(735): n = a, g, c or t
atgggatcaatagccagaagaaccattggttcaactcctcaatggtggaaagaagcagtcgtatatcaaatctatcccgcttcgtatctcgacaccaccggatctggagatggtgatctcaatggtatcacctcgaaattgccatatatcagatctctcggtgtagatgtagtatggatttcacctatctatgcatcccctatgaatgatatgggctatgatatttcggattatcgagctatcaaccctatgtttggtactatggaagattgggaacgtctttgcgccagagcacacgaactaggtttgaaactcgtgatggatctcgtggtaaatcacactagttctgaacacccctggttcaaagaatccgtctccggcggtcccaacggtcctaaaagagacttctactactggcaaccgcccaaaaatggtaaagagcccaataactggggtgccatgtttggaggttcatcctgggaaaaagatccttcgcatcaaacagacgaatactatctccacgtctacgacgtcagccagcccgatcttaattggacaaatccagccgttcgcaacgaggtctgggatatcatgcgcttttggcttgataagggatgtgatgggtttcgtatggatgtcatcaattgcatttcaaaagaacctggatttcccgattttgaagtcaccgatccgagactcgaattccagattggtgtgaggggaaannnnnnnnnncacgtcaaagagtacttggaagaaatgcatcgcgaagttctctgtcattatcccgaagcatttacagtgggagaaaccccaggactcaagagacccgagagtgcattgggcctggtccaaggaggaaaacctcttcaaatgatcttccaattcgagcatatgtacttcgacatccaacccggaatgaaacccttcttccctcgtccttcatggaatcttaccgagatcaagaaaaatctcggggagtggatgtctttcaatgcggcgcatgacggctgggactctctctacctagaaaatcacgatcaaccccgtattcttgggcgctgggcaaaagatactccggaatggagagtgcaagctgcaaaaatgctagcgttatttcatgcaaccggcagaggaaccctatttgtctatcaaggacaagaaatcggaacggcaaacagcaagtggtggaccaatgaagagttcagagatgtagaagagatcaatttctttgcggccgagaaggaacgtcgggagaaagaatcgaatgggaaagaagtagacatgactgatatctcccgaggaatccaaggctacggaagagacaattcgagaatggggatgcaatgggacgactctccaaatggcggtttcacacaaggtaaaccgtggatcaagacgaatgaggagtacaaggaaatcaacgtcgcagcgcaagatggagtcaagggaagcacattagagttctggaaacagataattaaactccggaaagagaatccggtgttgtgtaaagggggatttgaaatggtggatcaggagaacgaggaggtttatgcgtatgtgagaaagggcgaggagaaggagtatttgattgcttgcaatttcaaggagcgggatgtgaaatggaagattccggttgagactggggagcttttgtttggaagctatgaggacggagtacagggtggagagaaggagggagaattaaacttgagaccgttcgagggaagaatatatgttagagatatttga

SEQ ID NO: 528 - protein, 584 aa, Fungi
  DOMAIN (23)...(445): Alpha amylase, catalytic domain
  UNSURE (242)...(245): Xaa = any amino acid
MGSIARRTIGSTPQWWKEAVVYQIYPASYLDTTGSGDGDLNGITSKLPYIRSLGVDVVWISPIYASPMNDMGYDISDYRAINPMFGTMEDWERLCARAHELGLKLVMDLVVNHTSSEHPWFKESVSGGPNGPKRDFYYWQPPKNGKEPNNWGAMFGGSSWEKDPSHQTDEYYLHVYDVSQPDLNWTNPAVRNEVWDIMRFWLDKGCDGFRMDVINCISKEPGFPDFEVTDPRLEFQIGVRGXXXXHVKEYLEEMHREVLCHYPEAFTVGETPGLKRPESALGLVQGGKPLQMIFQFEHMYFDIQPGMKPFFPRPSWNLTEIKKNLGEWMSFNAAHDGWDSLYLENHDQPRILGRWAKDTPEWRVQAAKMLALFHATGRGTLFVYQGQEIGTANSKWWTNEEFRDVEEINFFAAEKERREKESNGKEVDMTDISRGIQGYGRDNSRMGMQWDDSPNGGFTQGKPWIKTNEEYKEINVAAQDGVKGSTLEFWKQIIKLRKENPVLCKGGFEMVDQENEEVYAYVRKGEEKEYLIACNFKERDVKWKIPVETGELLFGSYEDGVQGGEKEGELNLRPFEGRIYVRDI

SEQ ID NO: 529 - DNA, 1883 bp, Cochliobolus heterostrophus ATCC 48331
  CDS (1)...(1265): Exon
  CDS (1352)...(1883): Exon
atgtcagccgttgcacagaagaaagatttgtatgtcggcacagacaagcaccgatggtggaaggaggccgtggtataccagatctaccctgcctcattccttgacagtaacggcgatggttggggcgatgtaaagggcatcacatcgaagctggattacctcaaggatctaggcatcgatgtgatctggctatccccaatctacaaaagcccgcaagccgatatgggctacgacattgcagactacgaagatatagaccccagctatggtactttggctgatgtcgacaacctgatccacgaaaccaagaaacgcggcatgaagcttgtcatggatctggttgtcaaccacacctcagaagagcatgcatggtttctcgattctcgatcatccaaggaatcaaagaaaagagactggtatatctggaagccagcaaagtacgacgccgatggcaaccgtcagccgccaaacaactgggcacagatcttgggagaagccaactcggcgtggacatgggatgaaaagacacaggagtattacctttcactcttcacaccggagcagcccgacctcaactgggaaaatcctgatgtccgtgaggccgtacataacatcctccgcttctggctagatcgtggcgtctccggtttccgcatggatgtcatcaaccttatttcaaaggtccaaaccttccccgatgcaccaatctcagtcaaagatgccaagtaccaaccaggcgacaagtactttgccaacggcccccgcctacacgaatggctcaaggaactgcgccgcgatgtcctgtcaaagtatgacactctgaccgtaggcgaaatgccctttgtccgcgatgaagacgaagtcatcaaagtcgtcggctcagaaagcggtgagctgaacatgattttcaacttcgaccttgtcgacattgacaacgttcctggcgacttcaagtacacactgcacccctgggacgcacgcgatctcaagaaaatcgtaaacagactacagcgtctgatgcttgagcgtgacggttggaacacactatatgtggaaaaccacgaccagccccgcagcataagcagatatactgacgacagcgatgagtggcgctcctacggcgcaaagctgctctgccttatgcagacaaccctcgccggaaccctctacgtctatcaaggcgaggaaattggcatgcgcaacatacccaaagaatggggcccagaagagtacaaagacattgaaagtatcaatttcttcaaaaagtacgtgtccccatcttctcccctaacctccttccatccctcccccttttgtatctcgaaacgacgctttgaactaaacgacccagataccgcgacctttaccccaacaaccccgaaaaacaagccctcgcagcagaaatcatgcaacgcaaagcccgcgacagcgcccgaacacccatgcaatggaacgccgactcccaagcaggcttcacatccggaaccccctggatgcgcgtcaacacggactatcccgccatcaacgtcgccgagcaactcgccaaccccacgcccgcccccggtactctgtccgtccatgcgttctggaagcgtgccctggagtaccgcaaggaaaacaaggacgttttcgtgtacggggattttgaaatgctggatatgggacatgagaaggttgtggcgtttaggcggtggggcaaggataaggcgtttatcactgtgctgaattttagcggtgaggaggttaagtggggaggtttgggtgaaataaaggtgaagaagtgggttgcggggaattatgatgagagggagttggaaacgaaggccaagagtggggcgttggagttgagggcttgggaggggttgctgggacttttggagtga

SEQ ID NO: 530 - protein, 422 aa, Cochliobolus heterostrophus ATCC 48331
MSAVAQKKDLYVGTDKHRWWKEAVVYQIYPASFLDSNGDGWGDVKGITSKLDYLKDLGIDVIWLSPIYKSPQADMGYDIADYEDIDPSYGTLADVDNLIHETKKRGMKLVMDLVVNHTSEEHAWFLDSRSSKESKKRDWYIWKPAKYDADGNRQPPNNWAQILGEANSAWTWDEKTQEYYLSLFTPEQPDLNWENPDVREAVHNILRFWLDRGVSGFRMDVINLISKVQTFPDAPISVKDAKYQPGDKYFANGPRLHEWLKELRRDVLSKYDTLTVGEMPFVRDEDEVIKVVGSESGELNMIFNFDLVDIDNVPGDFKYTLHPWDARDLKKIVNRLQRLMLERDGWNTLYVENHDQPRSISRYTDDSDEWRSYGAKLLCLMQTTLAGTLYVYQGEEIGMRNIPKEWGPEEYKDIESINFFKK

SEQ ID NO: 531 - protein, 176 aa, Cochliobolus heterostrophus ATCC 48331
YRDLYPNNPEKQALAAEIMQRKARDSARTPMQWNADSQAGFTSGTPWMRVNTDYPAINVAEQLANPTPAPGTLSVHAFWKRALEYRKENKDVFVYGDFEMLDMGHEKVVAFRRWGKDKAFITVLNFSGEEVKWGGLGEIKVKKWVAGNYDERELETKAKSGALELRAWEGLLGLLE

SEQ ID NO: 532 - DNA, 1797 bp, Cochliobolus heterostrophus ATCC 48331
atgtcagccgttgcacagaagaaagatttgtatgtcggcacagacaagcaccgatggtggaaggaggccgtggtataccagatctaccctgcctcattccttgacagtaacggcgatggttggggcgatgtaaagggcatcacatcgaagctggattacctcaaggatctaggcatcgatgtgatctggctatccccaatctacaaaagcccgcaagccgatatgggctacgacattgcagactacgaagatatagaccccagctatggtactttggctgatgtcgacaacctgatccacgaaaccaagaaacgcggcatgaagcttgtcatggatctggttgtcaaccacacctcagaagagcatgcatggtttctcgattctcgatcatccaaggaatcaaagaaaagagactggtatatctggaagccagcaaagtacgacgccgatggcaaccgtcagccgccaaacaactgggcacagatcttgggagaagccaactcggcgtggacatgggatgaaaagacacaggagtattacctttcactcttcacaccggagcagcccgacctcaactgggaaaatcctgatgtccgtgaggccgtacataacatcctccgcttctggctagatcgtggcgtctccggtttccgcatggatgtcatcaaccttatttcaaaggtccaaaccttccccgatgcaccaatctcagtcaaagatgccaagtaccaaccaggcgacaagtactttgccaacggcccccgcctacacgaatggctcaaggaactgcgccgcgatgtcctgtcaaagtatgacactctgaccgtaggcgaaatgccctttgtccgcgatgaagacgaagtcatcaaagtcgtcggctcagaaagcggtgagctgaacatgattttcaacttcgaccttgtcgacattgacaacgttcctggcgacttcaagtacacactgcacccctgggacgcacgcgatctcaagaaaatcgtaaacagactacagcgtctgatgcttgagcgtgacggttggaacacactatatgtggaaaaccacgaccagccccgcagcataagcagatatactgacgacagcgatgagtggcgctcctacggcgcaaagctgctctgccttatgcagacaaccctcgccggaaccctctacgtctatcaaggcgaggaaattggcatgcgcaacatacccaaagaatggggcccagaagagtacaaagacattgaaagtatcaatttcttcaaaaaataccgcgacctttaccccaacaaccccgaaaaacaagccctcgcagcagaaatcatgcaacgcaaagcccgcgacagcgcccgaacacccatgcaatggaacgccgactcccaagcaggcttcacatccggaaccccctggatgcgcgtcaacacggactatcccgccatcaacgtcgccgagcaactcgccaaccccacgcccgcccccggtactctgtccgtccatgcgttctggaagcgtgccctggagtaccgcaaggaaaacaaggacgttttcgtgtacggggattttgaaatgctggatatgggacatgagaaggttgtggcgtttaggcggtggggcaaggataaggcgtttatcactgtgctgaattttagcggtgaggaggttaagtggggaggtttgggtgaaataaaggtgaagaagtgggttgcggggaattatgatgagagggagttggaaacgaaggccaagagtggggcgttggagttgagggcttgggaggggttgctgggacttttggagtga

SEQ ID NO: 533 - protein, 598 aa, Cochliobolus heterostrophus ATCC 48331
  DOMAIN (27)...(450): Alpha amylase, catalytic domain
MSAVAQKKDLYVGTDKHRWWKEAVVYQIYPASFLDSNGDGWGDVKGITSKLDYLKDLGIDVIWLSPIYKSPQADMGYDIADYEDIDPSYGTLADVDNLIHETKKRGMKLVMDLVVNHTSEEHAWFLDSRSSKESKKRDWYIWKPAKYDADGNRQPPNNWAQILGEANSAWTWDEKTQEYYLSLFTPEQPDLNWENPDVREAVHNILRFWLDRGVSGFRMDVINLISKVQTFPDAPISVKDAKYQPGDKYFANGPRLHEWLKELRRDVLSKYDTLTVGEMPFVRDEDEVIKVVGSESGELNMIFNFDLVDIDNVPGDFKYTLHPWDARDLKKIVNRLQRLMLERDGWNTLYVENHDQPRSISRYTDDSDEWRSYGAKLLCLMQTTLAGTLYVYQGEEIGMRNIPKEWGPEEYKDIESINFFKKYRDLYPNNPEKQALAAEIMQRKARDSARTPMQWNADSQAGFTSGTPWMRVNTDYPAINVAEQLANPTPAPGTLSVHAFWKRALEYRKENKDVFVYGDFEMLDMGHEKVVAFRRWGKDKAFITVLNFSGEEVKWGGLGEIKVKKWVAGNYDERELETKAKSGALELRAWEGLLGLLE

SEQ ID NO: 534 - DNA, 1922 bp, Cochliobolus heterostrophus ATCC 48331
  CDS (1)...(262): Exon
  CDS (316)...(425): Exon
  CDS (483)...(1002): Exon
  CDS (1045)...(1922): Exon
atgttgttgctcaacatcttcaccaccctcttcttctacatcacctgcatcgtctccgccgccgacaccaatgcttggaagtcccgcagcatctactttgtcctgacggatcgtattgcccgcaacagcagcgacacgggcggctcagcgtgcagcgacctcggcaactactgcggtggaactttccagggcctcgagtctaagctcgactacatcaagggacttggattcgatgccatttggattacccccgtcgtctcaagtatgttcatcacggcttctgccaacacagagcagtactaatccaacttgtagacaaggctgctggataccatggctactgggccgaggacttgtatgccgtcaactcaaactacggcactgctgccgacttgaagagcttggttgccgctgcccatgccaaggtatgtccggatttagtatctatgttcatagctagtacatttgcttactcatcatagggcatctacatgatggtcgacgttgtcgcaaaccacatgggtcctggagcaatcacaaacaaccgccctgaacctctcaaccaggcttcatcataccaccctccttgcaacatcgactacaacaaccaaaccagtgtcgaggtatgtcaaatagccggactccccgacatctacaccaccaagagcgagatccgcacgctcctcaacacctgggtcaactggctcgtaaacgagtacagcttcgacggtgtccgcatcgacaccgtcaagcacgtcgaaaaggacttttggcctggcttctctgccgctaccggtgtctacaacattggcgaggtgtttgacggagacccagcctaccttgccccgtacgccaagcttatgcccggcctcctcaactacgcagtctactacccgatgaacaacttttaccagcaaacgggctcttcccaggcgcttgtagacatgatgaacactgtcagcaacaccttccctgacccatctgccttgggaaccttcctcggtctagaactagtggatcccccgggctgcaggaattcgatagacaaccacgacaacaagcgctggttgaacgtcaagaacgaccagactctgctcaagaacgctcttgcttatgtcatcctcgcacgtggtatccccatcttgtactatggtaccgagcagggatacgctggtggtgacgacccagctaaccgagaggatctgtggcgcagtggcttcaacaccaatgccaacctctaccaagccatcaagaaactgaccgccgcccgacaggctgccggtggtctcgcaggaaacgaccacgtccacctgtacgtcgccgacacggcttacgcctggagccgtgccaacggcaacctgattgtcctcaccaccaacgctggcggcaactccaacacccagcactgcttcaacacgcaaaaggcaaacggccgctggaccaacgtctacggcaacggcgccaccgtctctgccgatagcaacggccaaatctgcgtctccgtcacaaacggcgagcccgttgtcctcctcgccggctccgctacccccaccactggcactaccctctccacccgcaccgccactgccaccgccacaccaaccgcatgccccaccgccgtctccgtctccttcacccaccgcgtcaccactgttcccggtgacaccatcaaaatcactggcaacacggcccagctaggtaactggactcccgccaacggccttgccttgtccgcagctagctacacatccagcaaccctatctggaccattaccgtgcccctggccgctggatcctccatctcgtacaagtttgtcaagattgacagtggaggaactgtcacctgggagagtgaccccaacaggtcatacactgcgccgagctgccaggcgagtgccagtgtgaacagctcatggcaatag

SEQ ID NO: 535 - protein, 87 aa, Cochliobolus heterostrophus ATCC 48331
MLLLNIFTTLFFYITCIVSAADTNAWKSRSIYFVLTDRIARNSSDTGGSACSDLGNYCGGTFQGLESKLDYIKGLGFDAIWITPVVS

SEQ ID NO: 536 - protein, 37 aa, Cochliobolus heterostrophus ATCC 48331
NKAAGYHGYWAEDLYAVNSNYGTAADLKSLVAAAHAK

SEQ ID NO: 537 - protein, 173 aa, Cochliobolus heterostrophus ATCC 48331
GIYMMVDVVANHMGPGAITNNRPEPLNQASSYHPPCNIDYNNQTSVEVCQIAGLPDIYTTKSEIRTLLNTWVNWLVNEYSFDGVRIDTVKHVEKDFWPGFSAATGVYNIGEVFDGDPAYLAPYAKLMPGLLNYAVYYPMNNFYQQTGSSQALVDMMNTVSNTFPDPSALGTFL

SEQ ID NO: 538 - protein, 292 aa, Cochliobolus heterostrophus ATCC 48331
DNHDNKRWLNVKNDQTLLKNALAYVILARGIPILYYGTEQGYAGGDDPANREDLWRSGFNTNANLYQAIKKLTAARQAAGGLAGNDHVHLYVADTAYAWSRANGNLIVLTTNAGGNSNTQHCFNTQKANGRWTNVYGNGATVSADSNGQICVSVTNGEPVVLLAGSATPTTGTTLSTRTATATATPTACPTAVSVSFTHRVTTVPGDTIKITGNTAQLGNWTPANGLALSAASYTSSNPIWTITVPLAAGSSISYKFVKIDSGGTVTWESDPNRSYTAPSCQASASVNSSWQ

SEQ ID NO: 539 - DNA, 1770 bp, Cochliobolus heterostrophus ATCC 48331
atgttgttgctcaacatcttcaccaccctcttcttctacatcacctgcatcgtctccgccgccgacaccaatgcttggaagtcccgcagcatctactttgtcctgacggatcgtattgcccgcaacagcagcgacacgggcggctcagcgtgcagcgacctcggcaactactgcggtggaactttccagggcctcgagtctaagctcgactacatcaagggacttggattcgatgccatttggattacccccgtcgtctcaaacaaggctgctggataccatggctactgggccgaggacttgtatgccgtcaactcaaactacggcactgctgccgacttgaagagcttggttgccgctgcccatgccaagggcatctacatgatggtcgacgttgtcgcaaaccacatgggtcctggagcaatcacaaacaaccgccctgaacctctcaaccaggcttcatcataccaccctccttgcaacatcgactacaacaaccaaaccagtgtcgaggtatgtcaaatagccggactccccgacatctacaccaccaagagcgagatccgcacgctcctcaacacctgggtcaactggctcgtaaacgagtacagcttcgacggtgtccgcatcgacaccgtcaagcacgtcgaaaaggacttttggcctggcttctctgccgctaccggtgtctacaacattggcgaggtgtttgacggagacccagcctaccttgccccgtacgccaagcttatgcccggcctcctcaactacgcagtctactacccgatgaacaacttttaccagcaaacgggctcttcccaggcgcttgtagacatgatgaacactgtcagcaacaccttccctgacccatctgccttgggaaccttcctcgacaaccacgacaacaagcgctggttgaacgtcaagaacgaccagactctgctcaagaacgctcttgcttatgtcatcctcgcacgtggtatccccatcttgtactatggtaccgagcagggatacgctggtggtgacgacccagctaaccgagaggatctgtggcgcagtggcttcaacaccaatgccaacctctaccaagccatcaagaaactgaccgccgcccgacaggctgccggtggtctcgcaggaaacgaccacgtccacctgtacgtcgccgacacggcttacgcctggagccgtgccaacggcaacctgattgtcctcaccaccaacgctggcggcaactccaacacccagcactgcttcaacacgcaaaaggcaaacggccgctggaccaacgtctacggcaacggcgccaccgtctctgccgatagcaacggccaaatctgcgtctccgtcacaaacggcgagcccgttgtcctcctcgccggctccgctacccccaccactggcactaccctctccacccgcaccgccactgccaccgccacaccaaccgcatgccccaccgccgtctccgtctccttcacccaccgcgtcaccactgttcccggtgacaccatcaaaatcactggcaacacggcccagctaggtaactggactcccgccaacggccttgccttgtccgcagctagctacacatccagcaaccctatctggaccattaccgtgcccctggccgctggatcctccatctcgtacaagtttgtcaagattgacagtggaggaactgtcacctgggagagtgaccccaacaggtcatacactgcgccgagctgccaggcgagtgccagtgtgaacagctcatggcaatag

SEQ ID NO: 540 - protein, 589 aa, Cochliobolus heterostrophus ATCC 48331
  SIGNAL (1)...(20)
  DOMAIN (33)...(373): Alpha amylase, catalytic domain
  DOMAIN (489)...(586): Starch binding domain
MLLLNIFTTLFFYITCIVSAADTNAWKSRSIYFVLTDRIARNSSDTGGSACSDLGNYCGGTFQGLESKLDYIKGLGFDAIWITPVVSNKAAGYHGYWAEDLYAVNSNYGTAADLKSLVAAAHAKGIYMMVDVVANHMGPGAITNNRPEPLNQASSYHPPCNIDYNNQTSVEVCQIAGLPDIYTTKSEIRTLLNTWVNWLVNEYSFDGVRIDTVKHVEKDFWPGFSAATGVYNIGEVFDGDPAYLAPYAKLMPGLLNYAVYYPMNNFYQQTGSSQALVDMMNTVSNTFPDPSALGTFLDNHDNKRWLNVKNDQTLLKNALAYVILARGIPILYYGTEQGYAGGDDPANREDLWRSGFNTNANLYQAIKKLTAARQAAGGLAGNDHVHLYVADTAYAWSRANGNLIVLTTNAGGNSNTQHCFNTQKANGRWTNVYGNGATVSADSNGQICVSVTNGEPVVLLAGSATPTTGTTLSTRTATATATPTACPTAVSVSFTHRVTTVPGDTIKITGNTAQLGNWTPANGLALSAASYTSSNPIWTITVPLAAGSSISYKFVKIDSGGTVTWESDPNRSYTAPSCQASASVNSSWQ

SEQ ID NO: 541 - DNA, 2037 bp, Fungi
  CDS (1)...(109): Exon
  CDS (155)...(2037): Exon
atgaatgttacgctgcattgtttgagcggagagtccgttatgtgcggcgttgatcagagaaaggatctgatctccacaagtaacggggtgatgtcggccgataagatgggtaaataataaacacctcgtcttcccctctcaacaatattccaagcccatcactcccattttaccatcatctcttctattctctccctctccgttcatccagccatcatgggctccatcatctgggacgatgaacaccaatacataggcaaacagccctggtggaaagccgcatccttctatcaagtctacccagccagcttcaaagactccaacaacgacggctggggcgatttacccggtctcatctccaagctcgattatctaagcgatcttggcatcgacgtcgtatgggtatctcccattttcgagagtcctcagaaagacatgggctacgacgtctcagactatcaaaaaatctacgaaccctacggcagtgttgaagatgtcgatattctcgtcaaagaatgccatgcgcgaggtctcaagattattctcgatcttgttgtgaatcacacgtcgatagagcacgagtggttcaaagaatcgaggtcttcaaaggacaatcccaagagggattggtatatctggaaaccagcgcggtatgatgagaacggcgtgagatatcctcctacgaactggaggggatattttgcgtgctcgacgtggacttgggacgagcacacgcaagaatactatcttcatctttatgcgcctgatcaacctgatttgaattgggacaatgatgagtgtcgagaagcgatttacgaaaatactatgcgcttttggcttgatcgcggcgttgatgggtttcgcattgataccgttaacaaatactccaagaggcgagactttgtcgacgcgcctatcacggatccctcgtcgcctcatcagcctgcgcctgaaatgtggtgcaacggaccgcgcattcatgagtttatccatgaaatgtatgagaaagtccttgggccttataatgcggtttcagtgggtgagctttcaaacacgcctaatccttcacaagtcattccctatgtctcagccgctgcgaaagagttggacatggtgtttgagttctccatgatcagacttggtaatggcaatgggtttggtgacaagtatatttacgaaccgttcccgttatcgaagctcaaggcgtttgtgtataagtggcagagctttattgagggtacagacgcgtgggcaacagctttctgcgagaaccacgacaatggccgtgcggtcgaccgtttcggtgacgcgtcaacgccagagtggtggctaaagtcagcaaagactttggctacctggcaaacgacgctcacgggcactttattcctataccaaggacaagaaattggcatgaccaacatgcccaagtcgtggggaattgaagaatacaaggatatcgaaagcagcaacttctacgctgaagccgtcgcgtcaggagacgagaagcgcgttagagacaccatgcacggtcttcaaatcatggcgcgtgatcactcgcgtattcccttccaatgggatgattcacccaacgctggctttgccgacgcgtctgcgaagccatggatgagagtccacgatgactatcgcgatatcaacgtcgctaagcaggtcaaagacccaaactccattctcagtttctacaaagccatgctgcgccttcgaaaagaatatcaagatatctttgtatttggttctttcaaacttctagatcctgaagatgaatcgctgttttgttatgtgaaagagagtgttgcacctgttaagggacgacggggtgagaagaggaaggctgttgttgtgttgaatatgagtcgagaggatagacttggcccggatgttcctactgtcttgggatgctcgcatgaggatgtgaggttgatggcgtatacgagggagactgcgggcggattgaaagtgggacggccgatgcttgcgggctgggagagtcgggtttatgttaactttgagctggaatag

SEQ ID NO: 542 - protein, 36 aa, Fungi
MNVTLHCLSGESVMCGVDQRKDLISTSNGVMSADKM

SEQ ID NO: 543 - protein, 627 aa, Fungi
AHHSHFTIISSILSLSVHPAIMGSIIWDDEHQYIGKQPWWKAASFYQVYPASFKDSNNDGWGDLPGLISKLDYLSDLGIDVVWVSPIFESPQKDMGYDVSDYQKIYEPYGSVEDVDILVKECHARGLKIILDLVVNHTSIEHEWFKESRSSKDNPKRDWYIWKPARYDENGVRYPPTNWRGYFACSTWTWDEHTQEYYLHLYAPDQPDLNWDNDECREAIYENTMRFWLDRGVDGFRIDTVNKYSKRRDFVDAPITDPSSPHQPAPEMWCNGPRIHEFIHEMYEKVLGPYNAVSVGELSNTPNPSQVIPYVSAAAKELDMVFEFSMIRLGNGNGFGDKYIYEPFPLSKLKAFVYKWQSFIEGTDAWATAFCENHDNGRAVDRFGDASTPEWWLKSAKTLATWQTTLTGTLFLYQGQEIGMTNMPKSWGIEEYKDIESSNFYAEAVASGDEKRVRDTMHGLQIMARDHSRIPFQWDDSPNAGFADASAKPWMRVHDDYRDINVAKQVKDPNSILSFYKAMLRLRKEYQDIFVFGSFKLLDPEDESLFCYVKESVAPVKGRRGEKRKAVVVLNMSREDRLGPDVPTVLGCSHEDVRLMAYTRETAGGLKVGRPMLAGWESRVYVNFELE

SEQ ID NO: 544 - DNA, 1992 bp, Fungi
atgaatgttacgctgcattgtttgagcggagagtccgttatgtgcggcgttgatcagagaaaggatctgatctccacaagtaacggggtgatgtcggccgataagatggcccatcactcccattttaccatcatctcttctattctctccctctccgttcatccagccatcatgggctccatcatctgggacgatgaacaccaatacataggcaaacagccctggtggaaagccgcatccttctatcaagtctacccagccagcttcaaagactccaacaacgacggctggggcgatttacccggtctcatctccaagctcgattatctaagcgatcttggcatcgacgtcgtatgggtatctcccattttcgagagtcctcagaaagacatgggctacgacgtctcagactatcaaaaaatctacgaaccctacggcagtgttgaagatgtcgatattctcgtcaaagaatgccatgcgcgaggtctcaagattattctcgatcttgttgtgaatcacacgtcgatagagcacgagtggttcaaagaatcgaggtcttcaaaggacaatcccaagagggattggtatatctggaaaccagcgcggtatgatgagaacggcgtgagatatcctcctacgaactggaggggatattttgcgtgctcgacgtggacttgggacgagcacacgcaagaatactatcttcatctttatgcgcctgatcaacctgatttgaattgggacaatgatgagtgtcgagaagcgatttacgaaaatactatgcgcttttggcttgatcgcggcgttgatgggtttcgcattgataccgttaacaaatactccaagaggcgagactttgtcgacgcgcctatcacggatccctcgtcgcctcatcagcctgcgcctgaaatgtggtgcaacggaccgcgcattcatgagtttatccatgaaatgtatgagaaagtccttgggccttataatgcggtttcagtgggtgagctttcaaacacgcctaatccttcacaagtcattccctatgtctcagccgctgcgaaagagttggacatggtgtttgagttctccatgatcagacttggtaatggcaatgggtttggtgacaagtatatttacgaaccgttcccgttatcgaagctcaaggcgtttgtgtataagtggcagagctttattgagggtacagacgcgtgggcaacagctttctgcgagaaccacgacaatggccgtgcggtcgaccgtttcggtgacgcgtcaacgccagagtggtggctaaagtcagcaaagactttggctacctggcaaacgacgctcacgggcactttattcctataccaaggacaagaaattggcatgaccaacatgcccaagtcgtggggaattgaagaatacaaggatatcgaaagcagcaacttctacgctgaagccgtcgcgtcaggagacgagaagcgcgttagagacaccatgcacggtcttcaaatcatggcgcgtgatcactcgcgtattcccttccaatgggatgattcacccaacgctggctttgccgacgcgtctgcgaagccatggatgagagtccacgatgactatcgcgatatcaacgtcgctaagcaggtcaaagacccaaactccattctcagtttctacaaagccatgctgcgccttcgaaaagaatatcaagatatctttgtatttggttctttcaaacttctagatcctgaagatgaatcgctgttttgttatgtgaaagagagtgttgcacctgttaagggacgacggggtgagaagaggaaggctgttgttgtgttgaatatgagtcgagaggatagacttggcccggatgttcctactgtcttgggatgctcgcatgaggatgtgaggttgatggcgtatacgagggagactgcgggcggattgaaagtgggacggccgatgcttgcgggctgggagagtcgggtttatgttaactttgagctggaatag

SEQ ID NO: 545 - protein, 663 aa, Fungi
  DOMAIN (83)...(505): Alpha amylase, catalytic domain
MNVTLHCLSGESVMCGVDQRKDLISTSNGVMSADKMAHHSHFTIISSILSLSVHPAIMGSIIWDDEHQYIGKQPWWKAASFYQVYPASFKDSNNDGWGDLPGLISKLDYLSDLGIDVVWVSPIFESPQKDMGYDVSDYQKIYEPYGSVEDVDILVKECHARGLKIILDLVVNHTSIEHEWFKESRSSKDNPKRDWYIWKPARYDENGVRYPPTNWRGYFACSTWTWDEHTQEYYLHLYAPDQPDLNWDNDECREAIYENTMRFWLDRGVDGFRIDTVNKYSKRRDFVDAPITDPSSPHQPAPEMWCNGPRIHEFIHEMYEKVLGPYNAVSVGELSNTPNPSQVIPYVSAAAKELDMVFEFSMIRLGNGNGFGDKYIYEPFPLSKLKAFVYKWQSFIEGTDAWATAFCENHDNGRAVDRFGDASTPEWWLKSAKTLATWQTTLTGTLFLYQGQEIGMTNMPKSWGIEEYKDIESSNFYAEAVASGDEKRVRDTMHGLQIMARDHSRIPFQWDDSPNAGFADASAKPWMRVHDDYRDINVAKQVKDPNSILSFYKAMLRLRKEYQDIFVFGSFKLLDPEDESLFCYVKESVAPVKGRRGEKRKAVVVLNMSREDRLGPDVPTVLGCSHEDVRLMAYTRETAGGLKVGRPMLAGWESRVYVNFELE

SEQ ID NO: 546 - DNA, 2261 bp, Fungi
  CDS (1)...(328): Exon
  CDS (381)...(593): Exon
  CDS (648)...(803): Exon
  CDS (887)...(1025): Exon
  CDS (1079)...(2261): Exon
atggcttcttctctgctttcctccctcagctccatcagcactttcaacagcactcagatcctccaagctgttcaacctattatgcatacattcgctcccctccttttggttggcagtcttgccctccaaactatctatgctttgcctggccccagtaaagttgagcaacgcgccgaaatcctaaaacgctcagtggattcttttattgccaccgaaagtcctattgctttcagaaatcttttatgcaatatcggcgcagatggagcttgtgcttcaggggcagcttcgggtattgtggttgcttcgcctgacaaagtgagcccagattgttagtatttcatgatgccgtttgaatacatggaattctgatatgtaaacagatttttatacttggactcgagactccgcattggtattcaaagcccttgttgatacgtttatcagcagcagctattctgcatcacttcaacaggaaattgaaaattacatcagctcccaagctggacttcaaaccgtgtcaaacccttcaggtggtttatcatccggtggtctgggcgagcccaaatttaatgcggataagtcggcattcacaggtacgaaaattcgaaaactctatcctgatggtgactgacatgtgaactatacagggtcttggggaagacctcaacgagatggacccgctttacgtgctactgctatgattacctattcaaaatggttgattgccaacggatacacctccactgtgcaaactattgtttggccgatcatcagaaatgatctgtcttatgttactcaatattgtaagtcaacgggaagaaaaccaaattagtctaaaaatagatgaccctcttttcttggagcttttgattaacttaattcatagggaaccaaactggctttgatctctgggaagaggttcaaggctcaagtttcttcacagtcgctgctcaacatcgtgctcttgttgaaggtagtgcactggccgctcaaattggtcaaagctgtacctattgtgattctcagtaagcacatatgaaagaatatattcacatgcaggtactaatacattttgcagagccccacaggttctttgtttcctccaaagcttctggagttcatcctcgggatacatcatttccaacatcaaccaaaacagcggaagaaacggaaaagatgcaaacagtatcttgagttctatccagacctttgatcctaccgctgcatgtgatgccaccacgttccaaccatgctcagaccgtgctttggcaaatcacaaagttgtgactgattctttcagatctatctacagcatcaactctgggattgccgaaggtgtcgccgtttctgttggacgctacccagaagattcttactatggtggcaatccttggtatctcaatacccttgctgctgccgaacagctttatgatgctttatacacctggaatagaattggctctatcaccgtaacttccacttccctagcattcttcaaagatttcagctcttccatcacagccggaacatacgcatcctccacatcaacctacaccactctctacaacgccatcaaaacctatgccgacggctacgtcaatgtcgtcgcaacctacgcacaagccaacggttccctctcagaacaattcaacaaagccggcggcgctcccctctcagcctacgacctcacctggtcctatgctgccttcctcaccgccgctgcccgtcgcgcaggtgtcgtcccatactcatggggtgagccatccgcctccagcgtcccaggaacctgttctgctacctcggccatcggaacctattctaccgcaaccgccacttcctggcccgcatcgcaaacccccagcggaggaggaggaagtacccccacaaccagcacatccgccaccaccaagacaacttccacctcgaccaccacttcttcatgcgcaacagccacttcagtagctgttactttcaatgaattggtcactacctcctttggccaaacgatcaaactcgctggttccgtctctcaattgggaagttgggcaccggcttctgcgattgcattgagcgccgcgaagtacaccgctagtaatccgttgtggaccgtgactgttaacctaccagctggcacgacggtattgtataagtttattaacgtggcgagtgatgggacggttacctggcaggcggatccaaataagagttatactgttccggtaggctgtgctacgactgctactgttagtggtagctggtaa

SEQ ID NO: 547 - protein, 109 aa, Fungi
MASSLLSSLSSISTFNSTQILQAVQPIMHTFAPLLLVGSLALQTIYALPGPSKVEQRAEILKRSVDSFIATESPIAFRNLLCNIGADGACASGAASGIVVASPDKVSPD

SEQ ID NO: 548 - protein, 71 aa, Fungi
YFYTWTRDSALVFKALVDTFISSSYSASLQQEIENYISSQAGLQTVSNPSGGLSSGGLGEPKFNADKSAFT

SEQ ID NO: 549 - protein, 52 aa, Fungi
GSWGRPQRDGPALRATAMITYSKWLIANGYTSTVQTIVWPIIRNDLSYVTQY

SEQ ID NO: 550 - protein, 47 aa, Fungi
WNQTGFDLWEEVQGSSFFTVAAQHRALVEGSALAAQIGQSCTYCDSQ

SEQ ID NO: 551 - protein, 393 aa, Fungi
APQVLCFLQSFWSSSSGYIISNINQNSGRNGKDANSILSSIQTFDPTAACDATTFQPCSDRALANHKVVTDSFRSIYSINSGIAEGVAVSVGRYPEDSYYGGNPWYLNTLAAAEQLYDALYTWNRIGSITVTSTSLAFFKDFSSSITAGTYASSTSTYTTLYNAIKTYADGYVNVVATYAQANGSLSEQFNKAGGAPLSAYDLTWSYAAFLTAAARRAGVVPYSWGEPSASSVPGTCSATSAIGTYSTATATSWPASQTPSGGGGSTPTTSTSATTKTTSTSTTTSSCATATSVAVTFNELVTTSFGQTIKLAGSVSQLGSWAPASAIALSAAKYTASNPLWTVTVNLPAGTTVLYKFINVASDGTVTWQADPNKSYTVPVGCATTATVSGSW

SEQ ID NO: 552 - DNA, 2019 bp, Fungi
atggcttcttctctgctttcctccctcagctccatcagcactttcaacagcactcagatcctccaagctgttcaacctattatgcatacattcgctcccctccttttggttggcagtcttgccctccaaactatctatgctttgcctggccccagtaaagttgagcaacgcgccgaaatcctaaaacgctcagtggattcttttattgccaccgaaagtcctattgctttcagaaatcttttatgcaatatcggcgcagatggagcttgtgcttcaggggcagcttcgggtattgtggttgcttcgcctgacaaagtgagcccagattatttttatacttggactcgagactccgcattggtattcaaagcccttgttgatacgtttatcagcagcagctattctgcatcacttcaacaggaaattgaaaattacatcagctcccaagctggacttcaaaccgtgtcaaacccttcaggtggtttatcatccggtggtctgggcgagcccaaatttaatgcggataagtcggcattcacagggtcttggggaagacctcaacgagatggacccgctttacgtgctactgctatgattacctattcaaaatggttgattgccaacggatacacctccactgtgcaaactattgtttggccgatcatcagaaatgatctgtcttatgttactcaatattggaaccaaactggctttgatctctgggaagaggttcaaggctcaagtttcttcacagtcgctgctcaacatcgtgctcttgttgaaggtagtgcactggccgctcaaattggtcaaagctgtacctattgtgattctcaagccccacaggttctttgtttcctccaaagcttctggagttcatcctcgggatacatcatttccaacatcaaccaaaacagcggaagaaacggaaaagatgcaaacagtatcttgagttctatccagacctttgatcctaccgctgcatgtgatgccaccacgttccaaccatgctcagaccgtgctttggcaaatcacaaagttgtgactgattctttcagatctatctacagcatcaactctgggattgccgaaggtgtcgccgtttctgttggacgctacccagaagattcttactatggtggcaatccttggtatctcaatacccttgctgctgccgaacagctttatgatgctttatacacctggaatagaattggctctatcaccgtaacttccacttccctagcattcttcaaagatttcagctcttccatcacagccggaacatacgcatcctccacatcaacctacaccactctctacaacgccatcaaaacctatgccgacggctacgtcaatgtcgtcgcaacctacgcacaagccaacggttccctctcagaacaattcaacaaagccggcggcgctcccctctcagcctacgacctcacctggtcctatgctgccttcctcaccgccgctgcccgtcgcgcaggtgtcgtcccatactcatggggtgagccatccgcctccagcgtcccaggaacctgttctgctacctcggccatcggaacctattctaccgcaaccgccacttcctggcccgcatcgcaaacccccagcggaggaggaggaagtacccccacaaccagcacatccgccaccaccaagacaacttccacctcgaccaccacttcttcatgcgcaacagccacttcagtagctgttactttcaatgaattggtcactacctcctttggccaaacgatcaaactcgctggttccgtctctcaattgggaagttgggcaccggcttctgcgattgcattgagcgccgcgaagtacaccgctagtaatccgttgtggaccgtgactgttaacctaccagctggcacgacggtattgtataagtttattaacgtggcgagtgatgggacggttacctggcaggcggatccaaataagagttatactgttccggtaggctgtgctacgactgctactgttagtggtagctggtaa

SEQ ID NO: 553 - protein, 672 aa, Fungi
  SIGNAL (1)...(23)
  DOMAIN (74)...(494): Glycosyl hydrolases family 15
  DOMAIN (572)...(668): Starch binding domain
MASSLLSSLSSISTFNSTQILQAVQPIMHTFAPLLLVGSLALQTIYALPGPSKVEQRAEILKRSVDSFIATESPIAFRNLLCNIGADGACASGAASGIVVASPDKVSPDYFYTWTRDSALVFKALVDTFISSSYSASLQQEIENYISSQAGLQTVSNPSGGLSSGGLGEPKFNADKSAFTGSWGRPQRDGPALRATAMITYSKWLIANGYTSTVQTIVWPIIRNDLSYVTQYWNQTGFDLWEEVQGSSFFTVAAQHRALVEGSALAAQIGQSCTYCDSQAPQVLCFLQSFWSSSSGYIISNINQNSGRNGKDANSILSSIQTFDPTAACDATTFQPCSDRALANHKVVTDSFRSIYSINSGIAEGVAVSVGRYPEDSYYGGNPWYLNTLAAAEQLYDALYTWNRIGSITVTSTSLAFFKDFSSSITAGTYASSTSTYTTLYNAIKTYADGYVNVVATYAQANGSLSEQFNKAGGAPLSAYDLTWSYAAFLTAAARRAGVVPYSWGEPSASSVPGTCSATSAIGTYSTATATSWPASQTPSGGGGSTPTTSTSATTKTTSTSTTTSSCATATSVAVTFNELVTTSFGQTIKLAGSVSQLGSWAPASAIALSAAKYTASNPLWTVTVNLPAGTTVLYKFINVASDGTVTWQADPNKSYTVPVGCATTATVSGSW

SEQ ID NO: 554 - DNA, 1909 bp, Cochliobolus heterostrophus ATCC 48331
  CDS (1)...(387): Exon
  CDS (451)...(990): Exon
  CDS (1040)...(1909): Exon
atgacgacggcattgtcttctggccaagttgctcccaccccccacaccgccgccgcaatgacaatcactcctcgaccatggtggaaggatgctgtcgtctaccagatataccccgcctcgttcaaggacagcaacggcgacggcattggcgacctcaatggcatcatctcggaactcgactacatccgctccattggcgtcgatgtcatctgggtctgccccatgtacgactcgcctcaggtcgacatgggctacgacatccgcaactacgaggatgtctacagaccatatggaaccgtccaggacatgcagcggctgattgacgagacccactcacggggcatgaagatcatcctggatctcgtcgtcaaccacacttcagatcaggtatgctcgctctagtcacgtgatttgctgtggcattggccatcacatgctcactgcctacagcaccaatggttccaagaatcacgctcgtcaaaggacaatccaaagcgtgactggtacatttggcgtcccgcccgctacgtcgatggcgtacgcaaaccccccaacaactgggtctccaacttcaccggcagtgtctgggaatgggacgagcatacccaagaatactacctccacctcttctgtcctgagcagcccgacctcaactgggaaaatccagagacacgtaaagctatatacgagtcggccatggagttctggctcaagcgtggtgtcgacggcttccgcgttgataccgtcaacatgtacagtaagggcgatatgcgtgacgcacccatcaccgatccgggatcagagtggcagtttgccggctaccagtactgcaacggcccgcgaatggatgagttcctgggcgagatgaatcagattctggaaaagtatgatgccatgacagtcggcgagtgtccacacacacttgatatcaacagagtacaccaatacgtaagcgccaaggagaagcgactctccatggtgtttcaattcgtaagtggacctggccctattgcaataacctagtgctcacccaacccaggacgtagtcgatgttgggcaaggcccctacaaattccaaaccacgcccaagaactggacactgccacaactcaagcgggcaatagcccgcactcaagatctgattcggcctccatctgacagctggaccactgcttttctggagaaccacgaccaagctcggtcaattacgcgcttcacttctgacgccccacagcaccgtgtcgctggcggcaagatgcttgccctcatgctgagcgctcttagcggcacgctgttcatctaccaaggccaggaaatcggcatgacaaacttccccgaatcgtgggacatgagcgaatacaaggacgtcgagtcatccaattactacaagatggttgccaagcgcaccaacaacgatgtcgatgcgcttgctgctgcacacaagtcgttgcagcaccttgcgcgcgaccactcgcgcgtgcccatgagctggagtaccgcaccgtacaatggcttcagtccgcccgatgcaaaagacaagccatggatgcggccgctagaagacgcagacatttgcaatgcaaaggcgcaacaaaatgacaagacatctgtgctgggtttctggaaacacatgctgcagctgcgcaaggagcacaaggatttgctcgtcttcggtcagtacgacgatcttgacgttgacaatgagcaattttacattttcagcaagacgtggcagggaaagcgggcgctgtgtatttgcaactttacagatgagagcaagcagctggttttgccagagagcgtggcagcgcagaaaatgcagctgctggtaagtagtcggcaagacgagggcgtcgaggaaaagacgctagcgccgtacgagggaagggtctatctttatgtgcaatga

SEQ ID NO: 555 - protein, 129 aa, Cochliobolus heterostrophus ATCC 48331
MTTALSSGQVAPTPHTAAAMTITPRPWWKDAVVYQIYPASFKDSNGDGIGDLNGIISELDYIRSIGVDVIWVCPMYDSPQVDMGYDIRNYEDVYRPYGTVQDMQRLIDETHSRGMKIILDLVVNHTSDQ

SEQ ID NO: 556 - protein, 180 aa, Cochliobolus heterostrophus ATCC 48331
HQWFQESRSSKDNPKRDWYIWRPARYVDGVRKPPNNWVSNFTGSVWEWDEHTQEYYLHLFCPEQPDLNWENPETRKAIYESAMEFWLKRGVDGFRVDTVNMYSKGDMRDAPITDPGSEWQFAGYQYCNGPRMDEFLGEMNQILEKYDAMTVGECPHTLDINRVHQYVSAKEKRLSMVFQF

SEQ ID NO: 557 - protein, 289 aa, Cochliobolus heterostrophus ATCC 48331
DVVDVGQGPYKFQTTPKNWTLPQLKRAIARTQDLIRPPSDSWTTAFLENHDQARSITRFTSDAPQHRVAGGKMLALMLSALSGTLFIYQGQEIGMTNFPESWDMSEYKDVESSNYYKMVAKRTNNDVDALAAAHKSLQHLARDHSRVPMSWSTAPYNGFSPPDAKDKPWMRPLEDADICNAKAQQNDKTSVLGFWKHMLQLRKEHKDLLVFGQYDDLDVDNEQFYIFSKTWQGKRALCICNFTDESKQLVLPESVAAQKMQLLVSSRQDEGVEEKTLAPYEGRVYLYVQ

SEQ ID NO: 558 - DNA, 1797 bp, Cochliobolus heterostrophus ATCC 48331
atgacgacggcattgtcttctggccaagttgctcccaccccccacaccgccgccgcaatgacaatcactcctcgaccatggtggaaggatgctgtcgtctaccagatataccccgcctcgttcaaggacagcaacggcgacggcattggcgacctcaatggcatcatctcggaactcgactacatccgctccattggcgtcgatgtcatctgggtctgccccatgtacgactcgcctcaggtcgacatgggctacgacatccgcaactacgaggatgtctacagaccatatggaaccgtccaggacatgcagcggctgattgacgagacccactcacggggcatgaagatcatcctggatctcgtcgtcaaccacacttcagatcagcaccaatggttccaagaatcacgctcgtcaaaggacaatccaaagcgtgactggtacatttggcgtcccgcccgctacgtcgatggcgtacgcaaaccccccaacaactgggtctccaacttcaccggcagtgtctgggaatgggacgagcatacccaagaatactacctccacctcttctgtcctgagcagcccgacctcaactgggaaaatccagagacacgtaaagctatatacgagtcggccatggagttctggctcaagcgtggtgtcgacggcttccgcgttgataccgtcaacatgtacagtaagggcgatatgcgtgacgcacccatcaccgatccgggatcagagtggcagtttgccggctaccagtactgcaacggcccgcgaatggatgagttcctgggcgagatgaatcagattctggaaaagtatgatgccatgacagtcggcgagtgtccacacacacttgatatcaacagagtacaccaatacgtaagcgccaaggagaagcgactctccatggtgtttcaattcgacgtagtcgatgttgggcaaggcccctacaaattccaaaccacgcccaagaactggacactgccacaactcaagcgggcaatagcccgcactcaagatctgattcggcctccatctgacagctggaccactgcttttctggagaaccacgaccaagctcggtcaattacgcgcttcacttctgacgccccacagcaccgtgtcgctggcggcaagatgcttgccctcatgctgagcgctcttagcggcacgctgttcatctaccaaggccaggaaatcggcatgacaaacttccccgaatcgtgggacatgagcgaatacaaggacgtcgagtcatccaattactacaagatggttgccaagcgcaccaacaacgatgtcgatgcgcttgctgctgcacacaagtcgttgcagcaccttgcgcgcgaccactcgcgcgtgcccatgagctggagtaccgcaccgtacaatggcttcagtccgcccgatgcaaaagacaagccatggatgcggccgctagaagacgcagacatttgcaatgcaaaggcgcaacaaaatgacaagacatctgtgctgggtttctggaaacacatgctgcagctgcgcaaggagcacaaggatttgctcgtcttcggtcagtacgacgatcttgacgttgacaatgagcaattttacattttcagcaagacgtggcagggaaagcgggcgctgtgtatttgcaactttacagatgagagcaagcagctggttttgccagagagcgtggcagcgcagaaaatgcagctgctggtaagtagtcggcaagacgagggcgtcgaggaaaagacgctagcgccgtacgagggaagggtctatctttatgtgcaatga

SEQ ID NO: 559 - protein, 598 aa, Cochliobolus heterostrophus ATCC 48331
  SIGNAL (1)...(19)
  DOMAIN (35)...(443): Alpha amylase, catalytic domain
MTTALSSGQVAPTPHTAAAMTITPRPWWKDAVVYQIYPASFKDSNGDGIGDLNGIISELDYIRSIGVDVIWVCPMYDSPQVDMGYDIRNYEDVYRPYGTVQDMQRLIDETHSRGMKIILDLVVNHTSDQHQWFQESRSSKDNPKRDWYIWRPARYVDGVRKPPNNWVSNFTGSVWEWDEHTQEYYLHLFCPEQPDLNWENPETRKAIYESAMEFWLKRGVDGFRVDTVNMYSKGDMRDAPITDPGSEWQFAGYQYCNGPRMDEFLGEMNQILEKYDAMTVGECPHTLDINRVHQYVSAKEKRLSMVFQFDVVDVGQGPYKFQTTPKNWTLPQLKRAIARTQDLIRPPSDSWTTAFLENHDQARSITRFTSDAPQHRVAGGKMLALMLSALSGTLFIYQGQEIGMTNFPESWDMSEYKDVESSNYYKMVAKRTNNDVDALAAAHKSLQHLARDHSRVPMSWSTAPYNGFSPPDAKDKPWMRPLEDADICNAKAQQNDKTSVLGFWKHMLQLRKEHKDLLVFGQYDDLDVDNEQFYIFSKTWQGKRALCICNFTDESKQLVLPESVAAQKMQLLVSSRQDEGVEEKTLAPYEGRVYLYVQ

SEQ ID NO: 560 - DNA, 1897 bp, Fungi
  CDS (1)...(276): Exon
  CDS (443)...(577): Exon
  CDS (648)...(909): Exon
  CDS (1047)...(1897): Exon
atgttgaccacgtcggagaggaaaacttcgacggcattcgttacttggtcaatgttgtgggtggtgttgttgacatccttcgtgaaagatgtccacgctgccacttcagacgattggagaagccaatctatatatcaaattatcacagatcgattcgccagaacggatggctcgactacctatgcgtgtaacaacacagcacagctgtattgcggtggaacttttcaaggaattatcaaccagctagattacatccaggatatgggatttacggctgtgagtttgtctatctcagcttctccttacgctcttcgcacgaacgatccttctctctgttgtgtctcgtacgaccgtcgcgacgaaagatgggaaaatccaccagcctagacatcgtgaactgacttaatgccaaacttagatctggatttcaccggtggtacagaatatcaaccaaacaacggcatatgggcaaggctatcatggattttggagtcaagatatcactaagatcaacgaacatttcggaacagcagacgatctcaaactcttgtcgtcaaccttgcacgatcgtggcatggtaagctgcattcacattcgcaacccaatcacatggaacataagctctaactcaactgtgcgcattatagtatctaatgatcgatgcggtcattaacgacatggcatacgcagggaaagggagcgcagtcgattactccactctagttccgttcaacaaaaaagaatacttccatcctttctgttacattaccgattattccaacgcaacaaactttcaaaactgttggctgggagacgatacagtttcattgccagatctggataccgaatctgattttgtcaagcaaacatgggaaacctgggtaacagaaatggtggccaattattctcgtatgtacttctgatcatgaatctcactcaccccttgctctttctggaagtcttggctgtggggaaaatctggggaatattaatgcacaatacattccattgcaacaagagtgggctaacataatctcgaactttagttgatggtcttcgtatcgatgccgccaaacacgtcgacaagcctttctggcctggcttccaacaggccgctaatacattcactattggtgaagtttttgacgagctgcctaccaatgcatgcgaatgggccgtcgatgctctctcttctgtcctaaattatcctgcctggtattacattacgtctatcctctcaaactcaacgaatggtatgggaagtttaagctaccaattcgatcaaacccagcaatactgttacgatactacacttcttggtactttcagtgagaatcatgatgttgctcgttttggatcctacacgagtgacgtgtctcaaaggaaaaatgccctcacgttcgacttttttacagacggcattcctattgtatattacggagccgagcaaggccttgacggtgaaaacgatcctcaaaaccgtggggctctttggctaaatccaaccgggtatgatactaccgcagttctgtatcaacatatcaaaaccatgaatactgcccgcaatgccgtcaacaattacatgatagcaaccaattactctaattggagtccttactgggcatacaaagcatcggtcataaagcaagcagacgacgtattggtgtttaggaaagggttggtccattcgatcgtcacagctatcaccaatgtcggtaccgagggagcgactgttgggccttactacatcgaagacaccaatttcagcgaaggaaatctcctcattgagatcttgagctgtaacagcactgtcgcgggagtcggtggagctttcaccctcaccttgactagcggagagccacaggtatgtctatatagttttaacgcatatgcgtaa

SEQ ID NO: 561 - protein, 92 aa, Fungi
MLTTSERKTSTAFVTWSMLWVVLLTSFVKDVHAATSDDWRSQSIYQIITDRFARTDGSTTYACNNTAQLYCGGTFQGIINQLDYIQDMGFTA

SEQ ID NO: 562 - protein, 45 aa, Fungi
NINQTTAYGQGYHGFWSQDITKINEHFGTADDLKLLSSTLHDRGM

SEQ ID NO: 563 - protein, 87 aa, Fungi
YLMIDAVINDMAYAGKGSAVDYSTLVPFNKKEYFHPFCYITDYSNATNFQNCWLGDDTVSLPDLDTESDFVKQTWETWVTEMVANYS

SEQ ID NO: 564 - protein, 283 aa, Fungi
LDGLRIDAAKHVDKPFWPGFQQAANTFTIGEVFDELPTNACEWAVDALSSVLNYPAWYYITSILSNSTNGMGSLSYQFDQTQQYCYDTTLLGTFSENHDVARFGSYTSDVSQRKNALTFDFFTDGIPIVYYGAEQGLDGENDPQNRGALWLNPTGYDTTAVLYQHIKTMNTARNAVNNYMIATNYSNWSPYWAYKASVIKQADDVLVFRKGLVHSIVTAITNVGTEGATVGPYYIEDTNFSEGNLLIEILSCNSTVAGVGGAFTLTLTSGEPQVCLYSFNAYA

SEQ ID NO: 565 - DNA, 1524 bp, Fungi
atgttgaccacgtcggagaggaaaacttcgacggcattcgttacttggtcaatgttgtgggtggtgttgttgacatccttcgtgaaagatgtccacgctgccacttcagacgattggagaagccaatctatatatcaaattatcacagatcgattcgccagaacggatggctcgactacctatgcgtgtaacaacacagcacagctgtattgcggtggaacttttcaaggaattatcaaccagctagattacatccaggatatgggatttacggctaatatcaaccaaacaacggcatatgggcaaggctatcatggattttggagtcaagatatcactaagatcaacgaacatttcggaacagcagacgatctcaaactcttgtcgtcaaccttgcacgatcgtggcatgtatctaatgatcgatgcggtcattaacgacatggcatacgcagggaaagggagcgcagtcgattactccactctagttccgttcaacaaaaaagaatacttccatcctttctgttacattaccgattattccaacgcaacaaactttcaaaactgttggctgggagacgatacagtttcattgccagatctggataccgaatctgattttgtcaagcaaacatgggaaacctgggtaacagaaatggtggccaattattctcttgatggtcttcgtatcgatgccgccaaacacgtcgacaagcctttctggcctggcttccaacaggccgctaatacattcactattggtgaagtttttgacgagctgcctaccaatgcatgcgaatgggccgtcgatgctctctcttctgtcctaaattatcctgcctggtattacattacgtctatcctctcaaactcaacgaatggtatgggaagtttaagctaccaattcgatcaaacccagcaatactgttacgatactacacttcttggtactttcagtgagaatcatgatgttgctcgttttggatcctacacgagtgacgtgtctcaaaggaaaaatgccctcacgttcgacttttttacagacggcattcctattgtatattacggagccgagcaaggccttgacggtgaaaacgatcctcaaaaccgtggggctctttggctaaatccaaccgggtatgatactaccgcagttctgtatcaacatatcaaaaccatgaatactgcccgcaatgccgtcaacaattacatgatagcaaccaattactctaattggagtccttactgggcatacaaagcatcggtcataaagcaagcagacgacgtattggtgtttaggaaagggttggtccattcgatcgtcacagctatcaccaatgtcggtaccgagggagcgactgttgggccttactacatcgaagacaccaatttcagcgaaggaaatctcctcattgagatcttgagctgtaacagcactgtcgcgggagtcggtggagctttcaccctcaccttgactagcggagagccacaggtatgtctatatagttttaacgcatatgcgtaa

SEQ ID NO: 566 - protein, 507 aa, Fungi
  SIGNAL (1)...(33)
  DOMAIN (46)...(397): Alpha amylase, catalytic domain
MLTTSERKTSTAFVTWSMLWVVLLTSFVKDVHAATSDDWRSQSIYQIITDRFARTDGSTTYACNNTAQLYCGGTFQGIINQLDYIQDMGFTANINQTTAYGQGYHGFWSQDITKINEHFGTADDLKLLSSTLHDRGMYLMIDAVINDMAYAGKGSAVDYSTLVPFNKKEYFHPFCYITDYSNATNFQNCWLGDDTVSLPDLDTESDFVKQTWETWVTEMVANYSLDGLRIDAAKHVDKPFWPGFQQAANTFTIGEVFDELPTNACEWAVDALSSVLNYPAWYYITSILSNSTNGMGSLSYQFDQTQQYCYDTTLLGTFSENHDVARFGSYTSDVSQRKNALTFDFFTDGIPIVYYGAEQGLDGENDPQNRGALWLNPTGYDTTAVLYQHIKTMNTARNAVNNYMIATNYSNWSPYWAYKASVIKQADDVLVFRKGLVHSIVTAITNVGTEGATVGPYYIEDTNFSEGNLLIEILSCNSTVAGVGGAFTLTLTSGEPQVCLYSFNAYA

SEQ ID NO: 567 - DNA, 1446 bp, Unknown
  Obtained from an environmental sample
atggatttaacggcgccgaagcaagccaggggcaattgcatttgccaccccatggtttgtttttcggtgagcttcaacaggagtaagccagtgcttcgtcgatacttgttcctggtatttattctgctgctaagcggcgccaccaaagcagaagcggcttttgtacatttgtttgaatggcgttggctggatatcgccagcgagtgtgaaaattttctcggccccaagggttttagcgcggtgcagatttcaccaccgcaagagcatctggatcatcacacctggtgggcccgctaccagccggtatcgctgacaaagctaaccagccgtagcggcacagaaacagaattgcgcgagatggttgcgcgctgtgctgccgcaggtgtaaaaatttatgccgatgtggtcatcaacaactgggctactttacccggcgccagccgcataggtagtgcgggtagccagtgggaagcctaccaatacccggatctggggccggatgattttcattcgccgcgctgtggtatagaaacctatcaaaacgcacatcaggtgtggtactgcgaactctacggcatgccggatttatacactggcgcgcccggcccccaagcctatgtggcagattacatcaagcgtttaacggcgatgggcatcgccggttttcgtatggatgcggccaaacatattgcgccagcggatttgcaacagattcttgcccaggccgacaacccctgggtttttgcggaggttataggcacgccgggtgaagcgccggaaattcacccgcgccaatatctatcactcggtcatgttactgagtttgcctttggcaatctgctcgcccaggcgtttaacggccgcgtggatctattgcgtgatctgcccaaaagtgattggctgccgagcgaacaagcagtgatttttgtcgataaccatgatcgcgaacgcggccacggtggtgagggcaatctcacttacaaggatggcagccgctacaagttggccaatgtgtttatgctggcccagccctacggttatccggcaattatgtcgggctatgaatttaccgatacagatgccggccctccgcccggtgaaactcattgcgacaatcgcgcctgggtatgccagcaccgctggccagaagtggcgaatatgcttgggtttcgcgctcacacgcaaaatgaacctttgctgcactggtgggacaatggccgcgatcaactagcctttgcgcgcggcaagcgcggatttgtggcaattaacaacagcagcaagcgactcaatcgacgcatgcaaaccggattgcctgctggtcgttattgcaatcaattggcagagaagtccgcctgcaacgcgccaatcaacgtagacaaaaaaggtcgtgcctggattcgtgtaaagccaggtaatgcattggtgttgattaatctgtcaacctag

SEQ ID NO: 568 - protein, 481 aa, Unknown
  Obtained from an environmental sample
  DOMAIN (52)...(391): Alpha amylase, catalytic domain
  DOMAIN (400)...(481): Alpha amylase, C-terminal all-beta domain
MDLTAPKQARGNCICHPMVCFSVSFNRSKPVLRRYLFLVFILLLSGATKAEAAFVHLFEWRWLDIASECENFLGPKGFSAVQISPPQEHLDHHTWWARYQPVSLTKLTSRSGTETELREMVARCAAAGVKIYADVVINNWATLPGASRIGSAGSQWEAYQYPDLGPDDFHSPRCGIETYQNAHQVWYCELYGMPDLYTGAPGPQAYVADYIKRLTAMGIAGFRMDAAKHIAPADLQQILAQADNPWVFAEVIGTPGEAPEIHPRQYLSLGHVTEFAFGNLLAQAFNGRVDLLRDLPKSDWLPSEQAVIFVDNHDRERGHGGEGNLTYKDGSRYKLANVFMLAQPYGYPAIMSGYEFTDTDAGPPPGETHCDNRAWVCQHRWPEVANMLGFRAHTQNEPLLHWWDNGRDQLAFARGKRGFVAINNSSKRLNRRMQTGLPAGRYCNQLAEKSACNAPINVDKKGRAWIRVKPGNALVLINLST

SEQ ID NO: 569 - DNA, 1095 bp, Thermococcus alcaliphilus AEDII12RA
ttgagagcgctcgtctttcacggcaacctccagtatgccgaaatcccaaagagcgaaatcccaaaggtcatagagaaggcatacatcccagtcatcgagacactgattaaagaagaaattccttttgggctcaacataacgggctataccttaaagttcctcccgaaggatattatagacctcgttaaagggggcatcgcgagtgacctgatagagataatcggaacgagctacacgcacgcaatactccccctcctgccgcttagcagagtagaagcacaagttcagagagatagggaagttaaggaagagctcttcgaggtttctccaaagggattctggctgccagagctcgcctatgacccgataatccctgccatactgaaggacaacggttatgagtatctattcgccgacggggaggcgatgcttttctcagctcatctcaactcggcgataaagccaattaaaccgctctatccacaccttataaaggcccaaagggaaaagcgctttaggtacatcagctatctccttggtctcagggagcttaggaaggcgataaagctcgtttttgaaggtaaggtaacgctaaaggcagtcaaagacatcgaagccgtacccgtttgggtggccgtgaacacggctgtaatgctcggcatcggaaggcttcctcttatgaatcctaagaaagtggcgagctggatagaggacaaggacaacattcttctatacggcaccgatatagagttcattggctatagggacattgcaggctacagaatgagtgttgagggattattagaggttatagacgagctcaactcggaactgtgccttccctcagagctgaagcacagtggaagggagctctacttacggacttcgagttgggcaccagataagagcttgaggatatggagagaggacgaagggaacgcaagacttaatatgctgtcctacaatatgaggggcgaactcgcctttttagccgagaacagcgatgcaaggggatgggagcccctccctgagaggaggctggatgccttccgggcgatatataacgattggaggggtgaaaatggggaaccttag

SEQ ID NO: 570 - protein, 364 aa, Thermococcus alcaliphilus AEDII12RA
MRALVFHGNLQYAEIPKSEIPKVIEKAYIPVIETLIKEEIPFGLNITGYTLKFLPKDIIDLVKGGIASDLIEIIGTSYTHAILPLLPLSRVEAQVQRDREVKEELFEVSPKGFWLPELAYDPIIPAILKDNGYEYLFADGEAMLFSAHLNSAIKPIKPLYPHLIKAQREKRFRYISYLLGLRELRKAIKLVFEGKVTLKAVKDIEAVPVWVAVNTAVMLGIGRLPLMNPKKVASWIEDKDNILLYGTDIEFIGYRDIAGYRMSVEGLLEVIDELNSELCLPSELKHSGRELYLRTSSWAPDKSLRIWREDEGNARLNMLSYNMRGELAFLAENSDARGWEPLPERRLDAFRAIYNDWRGENGEP

SEQ ID NO: 571 - DNA, 1839 bp, Unknown
  Obtained from an environmental sample.
atgcaatcgaacggaaacgtgaaggggaggagcgccgttctagcgctggccctcctcctgttgacagcggttgccgccacggcccagaccaacggcacgatgatgcagtacttccactggtacaacagctcgtcagacaacctctggctcaaggtgaccgaccaggccgacgagctgtccgcggccggcatcaccgccctctggctgccccccgcctacaaggcgatcaacggcgacgacgtggggtatggcgtctacgatctctacgacctcggcgagttcaaccagaaggggtcggtgcgcaccaaatacggcaccagggcccagtacctcgccgccatcaacgcggctcacgccaacggcctgcaggtctacggcgacgtggtcttcaaccacaagggcggcgcggacttcaccgagtgggtgacggcgacccgggtgcagacctgggaccgcaaccaggagtacggaggcgatctctccatccaggcctggaccggcttcgacttccccggccggggcaacacctactccgcgttcaaatggcgctggtaccacttcgacggcgtggactgggaccagaacctccaggagagcgggaagatctacaagttccgcggcaccggcaaggcctgggactggaaggtccacgacgagaacggcaactacgactatctgatgttcgccgacctcgacatgcagcacccggacgtcgtcaacgagctcaagagctggggcgtctggtacgccaacaccaccggggtcgacggcttccggctggatgccctcaagcacatcaagtacgacttctggaacggctggctggaccacgtgcgcaacaccacgggcaagccgctgttcaccgtcggcgagctctggagctacgacgtccagaacctgcacgactggatcacggagaccggcggccgggcctcgctgttcgacgcgccgctgcacctgaacttcttcaacgcgtcgcgggccggcgggagctatgacatgcgcgacctgatggacggcacgctgatggagcagcagccggccctggcagtgacgctggtcgagaaccacgacacgcagcctctccaggccctggagtcgccggtgatggactggttcaagcccctggcctacgccttcatcctgctgcgcgcggaaggctacccttccgtcttctacccggactactacggcgcgacctatacggacagaggccagaccgtcaccatcgcctcccagaaggcgatcctcgacaagctgctggacgcccgcaggaacttcgcctacgggacgcagtacgactacctcgatcactgggacgtcatcggctggacgcgcctgggcaacgcccagcatccccgggccatggccgtgatcctgagcgacggccccggtggctcgaagtggatggacgtgggcaaggccaacgcccgattcttcgatcacaccggcaaccgcgtggacgtggtgaccaccaacgggtcgggctgggggaacttcccggtcaacggcggctcggtctccgtctgggtgcaggaggaccccggccaggtgtcggtcctgttcacctgcaacaacggccagacggtgatgggccaggacgtatacgtgacgggcagcgtcgccaaattgggcaactgggacacgagcaaggccgtgaagctctcgccggtgagctacccgacctggagcgggtgggtgcacaacctccctccgagcacccagatccaatggaagtgcatcaagaagcaggggacgaacgtcgtctggcagccgggcgccaacaacgtcgtcacgaccccggccagcggctcgacgagctcgaccggggcgttctga

SEQ ID NO: 572 - protein, 612 aa, Unknown
  Obtained from an environmental sample.
  SIGNAL (1)...(28)
  DOMAIN (517)...(610): Starch binding domain
  DOMAIN (32)...(424): Alpha amylase, catalytic domain
MQSNGNVKGRSAVLALALLLLTAVAATAQTNGTMMQYFHWYNSSSDNLWLKVTDQADELSAAGITALWLPPAYKAINGDDVGYGVYDLYDLGEFNQKGSVRTKYGTRAQYLAAINAAHANGLQVYGDVVFNHKGGADFTEWVTATRVQTWDRNQEYGGDLSIQAWTGFDFPGRGNTYSAFKWRWYHFDGVDWDQNLQESGKIYKFRGTGKAWDWKVHDENGNYDYLMFADLDMQHPDVVNELKSWGVWYANTTGVDGFRLDALKHIKYDFWNGWLDHVRNTTGKPLFTVGELWSYDVQNLHDWITETGGRASLFDAPLHLNFFNASRAGGSYDMRDLMDGTLMEQQPALAVTLVENHDTQPLQALESPVMDWFKPLAYAFILLRAEGYPSVFYPDYYGATYTDRGQTVTIASQKAILDKLLDARRNFAYGTQYDYLDHWDVIGWTRLGNAQHPRAMAVILSDGPGGSKWMDVGKANARFFDHTGNRVDVVTTNGSGWGNFPVNGGSVSVWVQEDPGQVSVLFTCNNGQTVMGQDVYVTGSVAKLGNWDTSKAVKLSPVSYPTWSGWVHNLPPSTQIQWKCIKKQGTNVVWQPGANNVVTTPASGSTSSTGAF

SEQ ID NO: 573 - DNA, 2133 bp, Bacteria
atgaaaaaaacgtttaaattgatattggtgctgatgctttcacttacacttgtttttggattgacagcaccaatacaggcagcttctgatacagcagtaagtaatgttgtcaattactcgacggatgtaatttatcagattgtcactgatagatttgttgatggaaataccagcaacaatccaactggtgatttgtatgatccaacacatacaagtctgaaaaagtactttggtggagactggcagggtattattaacaagataaatgatggttatctaacaggaatgggtgtaacagcaatttggatatctcagcctgtagaaaatatttatgcagtcttacctgattcaacttttggtggaagtacatcgtaccatggttattgggctcgtgattttaagagaacaaatccatactttggaagctttactgattttcaaaatttgattaatacagctcatgcacataacataaaagtaattatcgattttgcaccaaatcatacttcacctgcatctgaaaccgatccgacttatgctgaaaatggaaggctatacgacaatggaacattacttggtgggtatacaaatgatacaaacgggtattttcatcattatggaggaacagatttttcatcttatgaagatggcatttatcgtaacttatttgatttagcagatttaaatcaacagaatagtacaatcgattcatacttaaaatcagcaattaaggtgtggctcgatatgggaatagacggtatacgtctagatgctgtaaaacatatgccgtttggatggcagaagaattttatggatagcatattgagctataggcctgtatttacatttggagagtggtttcttggaacgaatgaaattgatgtaaataacacatactttgcaaatgaaagcggtatgagtcttttggactttaggttttctcaaaaagtgaggcaggtatttagggataatacggatactatgtatggacttgattcaatgattcaatcaactgcatctgattataattttataaatgatatggttacttttattgataatcatgatatggatagattctataatggtggttctactcgtccagttgaacaagcattagcatttactttgacttcgaggggagtacctgctatatattatggaacagaacagtatatgacaggcaatggagacccttataatagagctatgatgacctcatttaatacatcaactacagcatataatgtaattaaaaaacttgctcctttgcgcaaatctaatcctgcaattgcttatggtactactcagcaacgttggataaacaatgatgtttatatatatgaaagaaaatttgggaataatgttgctcttgttgctataaatagaaatctttcaacaagttataatataacaggactgtatacagcgcttcctgctggtacttatactgatgttcttggtggacttttaaatggtaatagtatttctgtcgcgagtgatggttctgtaacaccatttacacttagtgccggtgaagttgcagtatggcagtatgtaagttcaagtaattctccgttgataggacatgttgggccaacaatgacaaaagcagggcaaactataacaatagatggaagaggttttggtacgacatcaggacaagttttgtttggttcgacggctggtactattgtctcttgggatgatacagaggtaaaagtaaaagttccttcggtgacacctggtaaatataatatatcattaaaaacttcaagtggtgctacaagcaatacttataataatattaacattcttacaggcaatcagatatgtgttagatttgttgtaaataatgcaagtacagtgtatggagagaatgtttatcttactggtaatgtagctgaattgggaaactgggatacgtcaaaagcaataggaccaatgtttaatcaggtagtatatcagtatcctacatggtattatgatgtaagtgttccagcgggtacaacaatacaatttaagtttataaagaaaaatggcaatacgataacatgggaaggtggtagtaaccatacttatacagttccatcatctagtacaggtactgtaattgtaaactggcaacaatag

SEQ ID NO: 574 - protein, 710 aa, Bacteria
  SIGNAL (1)...(27)
  DOMAIN (437)...(521): Alpha amylase, C-terminal all-beta domain
  DOMAIN (46)...(425): Alpha amylase, catalytic domain
  DOMAIN (526)...(603): IPT/TIG domain
  DOMAIN (610)...(706): Starch binding domain
MKKTFKLILVLMLSLTLVFGLTAPIQAASDTAVSNVVNYSTDVIYQIVTDRFVDGNTSNNPTGDLYDPTHTSLKKYFGGDWQGIINKINDGYLTGMGVTAIWISQPVENIYAVLPDSTFGGSTSYHGYWARDFKRTNPYFGSFTDFQNLINTAHAHNIKVIIDFAPNHTSPASETDPTYAENGRLYDNGTLLGGYTNDTNGYFHHYGGTDFSSYEDGIYRNLFDLADLNQQNSTIDSYLKSAIKVWLDMGIDGIRLDAVKHMPFGWQKNFMDSILSYRPVFTFGEWFLGTNEIDVNNTYFANESGMSLLDFRFSQKVRQVFRDNTDTMYGLDSMIQSTASDYNFINDMVTFIDNHDMDRFYNGGSTRPVEQALAFTLTSRGVPAIYYGTEQYMTGNGDPYNRAMMTSFNTSTTAYNVIKKLAPLRKSNPAIAYGTTQQRWINNDVYIYERKFGNNVALVAINRNLSTSYNITGLYTALPAGTYTDVLGGLLNGNSISVASDGSVTPFTLSAGEVAVWQYVSSSNSPLIGHVGPTMTKAGQTITIDGRGFGTTSGQVLFGSTAGTIVSWDDTEVKVKVPSVTPGKYNISLKTSSGATSNTYNNINILTGNQICVRFVVNNASTVYGENVYLTGNVAELGNWDTSKAIGPMFNQVVYQYPTWYYDVSVPAGTTIQFKFIKKNGNTITWEGGSNHTYTVPSSSTGTVIVNWQQ

SEQ ID NO: 575 - DNA, 1677 bp, Unknown
  Obtained from an environmental sample.
atgaaaagcgagttaccacaaattccaccacagcaggtgaacaacaccatgtaccaggcattttattgggatgcctaccctggcctttgggccaatttaccggccatggcggcccctttggccgaacggggcattacctcgatgtggttgccgcccgccgccaaaggcatgaatggtactttcagtgtcggttacgatgtatacgatttctgggatctgggcgagtttaaccaaaaaggcaccaccgccacccgttacggtactcgtcagcagctgcaacaagcactgagtgctctggaccaactgggtattcaggcctattttgatgtggtgtttaaccaccgcatgggcgccgatgcacaggagaatattcctggctttggcctggcctggaccgagtatcatctgcaaggtcgtcaggcgcattatacccagcaaaactggggctacttgtggcacgactttgactggaactggaccgcgtttaatggctccgacaatcagctctaccccggcaaatggtggggcaataccttccacttcccttatttgatgggtgaggatgtcgattacaaccgctttgaagtgcagcaggaaatgaaagcctggggcgagtggatcatcaacagcgttggctttagcggctttcggatggacgccatcgcacacgtggataccgattttacccgtgactggatcaatcacgtacagtgggccaccagcgaggatgtattctttgtcgcagaagcctgggtcagtgatatcaacggctatctggatgcagtcaatacgccgcatttgcgcgcttttgatttcaatttgcgcgaagactttgttgctttaagcagtggtggcaaagacatgcgctggtggggtggtctggttaatagccagcaccgtgatcgggcggtcacttttgtcgataaccacgataccagccgggccggcaacccttatggcatgccgcaggtgatcaactacaagaaccaggcctacgcttacattctgttgcgtgagcatggggtgccgactgtgtttgcccgcgattacgacgaatttggcatggcgccaacgctggataaattgattgaggcgcgccgctactttgcctatggtcctggtcatgagtactccggcaataccgaggccgtttacgcctatgtgcgcgaggggcttagcactgtgccgggcaccggtctggtgatgctgatatcgggtcgaaactggggtggtcagcagtcgttcaccatcaacagccatcagccgaataccaccttttacgattataccggcaatgtcagcggcacggtgaccaccaatgcgcagggttatggcagcttcccggtcactatgacggaaagtaccggttggtcagtctgggtaccacaatccagtggtggcactcagccgggatccattaccctgcggatgaccaaggatgttggctatggtttttcactgttcttcactggcagcagtgcagagctcaccaattggggcggcggtattgaaggcacctggaccagtggccatgtctgggaagtgaccatcccggatccgggcaactttgaatggaaaacccgtaaaggcccaaccggcggcagtggtcaggactgggaaagtggtagcaaccacaatcagaccaatttgcaccccagttttaatggtgggttttaa

SEQ ID NO: 576 - protein, 558 aa, Unknown
  Obtained from an environmental sample.
  DOMAIN (15)...(366): Alpha amylase, catalytic domain
MKSELPQIPPQQVNNTMYQAFYWDAYPGLWANLPAMAAPLAERGITSMWLPPAAKGMNGTFSVGYDVYDFWDLGEFNQKGTTATRYGTRQQLQQALSALDQLGIQAYFDVVFNHRMGADAQENIPGFGLAWTEYHLQGRQAHYTQQNWGYLWHDFDWNWTAFNGSDNQLYPGKWWGNTFHFPYLMGEDVDYNRFEVQQEMKAWGEWIINSVGFSGFRMDAIAHVDTDFTRDWINHVQWATSEDVFFVAEAWVSDINGYLDAVNTPHLRAFDFNLREDFVALSSGGKDMRWWGGLVNSQHRDRAVTFVDNHDTSRAGNPYGMPQVINYKNQAYAYILLREHGVPTVFARDYDEFGMAPTLDKLIEARRYFAYGPGHEYSGNTEAVYAYVREGLSTVPGTGLVMLISGRNWGGQQSFTINSHQPNTTFYDYTGNVSGTVTTNAQGYGSFPVTMTESTGWSVWVPQSSGGTQPGSITLRMTKDVGYGFSLFFTGSSAELTNWGGGIEGTWTSGHVWEVTIPDPGNFEWKTRKGPTGGSGQDWESGSNHNQTNLHPSFNGGF

SEQ ID NO: 577 - DNA, 2160 bp, Unknown
  Obtained from an environmental sample.
atgaaaccgtttttaaaaaaatctattatcacactgcttgcttccacctgtctctttacagcatggctcatcccctcaatcgccgtacctacggtaagcgccgctcccgatacgtcggttcttaacaaacagggcttctcaaccgatgtaatctatcaaatcgtgaccgaccgcttcgcggatggagatccttccaacaatccatccggcgcggcctattctcccggctgtacgaatctgaagctttattgcgggggagactggcggggaatcattaacaagattaacgagggttattttgccggaatgggtgtaagcgctttatggatctctcaaccggtcgaaaatatttacagcgtcatcgactactccggtgtcaacagcacatcctatcacgggtattgggctcgcgacttcaaacggacgaatccggcgtttggcagcatgagcgattttcaggagctcatcaacacggcacatgcccacaatatcaagatcattattgatttcgcacctaaccacacctcccctgcttcggagacacaaccttccttcgccgagaacggtcggctgtacgataatggcaacctgatcgctgggtacacgggggacaccaacggaattttccatcataatcagggcacgaatttctcctcgctcgaggatggcatctatcggaatctttatgatctggccgacatcaatcaccacaacaacgtaacggatacttacttcaaggacgcgattaagctctggctgaatatggggatcgatggcatccgggtggatgcggtgaagcatatgccggagggttggcagaaaaactgggtcgcttcgatcgcagggtataaaccggtgtttacctttggggaatggttccttggcgttggcgaaaatgatccgaacaacatccgattcgccaatgaatccgggatgagtctgctcgacttccaatttgggcaaaaggtccggcaggtcttccgcgacaattcagataatatgtacggtttaaataacatgctaaccacaacagcagctaactacaaacatattcatgaccaagtcacgtttatcgacaaccatgatatggatcgttttaagctgggtaataatgaccgtcgcttggagcaagcgttggccttcacgctgatgtcacgcggcgttccggccatctattacgggacggagcaatatatgacgggtaacggggatccggccaaccgtggttttatgagtggattttcaacttcaaccaccgcctatcaggtcatcggcaagctggcaccgcttcgcaaatcgaatccggcactggcatatggaagtacgcaggaacgctggatcaataatgatgtatttatcttcgagcgtaagttcggcagcagcgtagcgctagtcgcaattaaccgcagcacaaccaacgccacctcgatcaccggcttgcagacctcccttccggccggtacttacgcagacgagttgagcggactgcttaacggcggcagtattacggtaagttccacgggagccgtctccgcctttaacctgcctgcaggggccgtcgccgtatggcaatttgcagcgaacgagtccgcaccggtgattggcaatatcggaacggacctgggcaaagcaggcacgacgctgacgattgatggccgaggctttggcagtacgaaagggacggtcttctttggcacgacggcagtcaccggcagccagattttgcagtgggaagattcccagatccaagtgacggttccggcaatcaccccagggcaatataacatcaaagtccgcagcgcttcctccgtagacagcaacagctacagcagctttaacctgctgacaggggatcaagtctcggtccgtttcatcatcaacaatgccaacacacaattaggcgaaaatgtctaccttacaggcaacatcgccgaacttggcaactgggatccgaacaaagcgatgggtccgttctttaatcagatcatcaggacgtatccgacctggtactacgatgttagcgtgccagccggaacaaccttggagttcaagtttattaaaaagaacgggacagccgtgacctgggaaggcggcgcgaaccacagcttcacaacgccaacgagcggtgtcggcacggttgaggtcaactggcagccataa

SEQ ID NO: 578 - protein, 719 aa, Unknown
  Obtained from an environmental sample.
  SIGNAL (1)...(34)
  DOMAIN (443)...(527): Alpha amylase, C-terminal all-beta domain
  DOMAIN (53)...(431): Alpha amylase, catalytic domain
  DOMAIN (532)...(615): IPT/TIG domain
  DOMAIN (619)...(715): Starch binding domain
MKPFLKKSIITLLASTCLFTAWLIPSIAVPTVSAAPDTSVLNKQGFSTDVIYQIVTDRFADGDPSNNPSGAAYSPGCTNLKLYCGGDWRGIINKINEGYFAGMGVSALWISQPVENIYSVIDYSGVNSTSYHGYWARDFKRTNPAFGSMSDFQELINTAHAHNIKIIIDFAPNHTSPASETQPSFAENGRLYDNGNLIAGYTGDTNGIFHHNQGTNFSSLEDGIYRNLYDLADINHHNNVTDTYFKDAIKLWLNMGIDGIRVDAVKHMPEGWQKNWVASIAGYKPVFTFGEWFLGVGENDPNNIRFANESGMSLLDFQFGQKVRQVFRDNSDNMYGLNNMLTTTAANYKHIHDQVTFIDNHDMDRFKLGNNDRRLEQALAFTLMSRGVPAIYYGTEQYMTGNGDPANRGFMSGFSTSTTAYQVIGKLAPLRKSNPALAYGSTQERWINNDVFIFERKFGSSVALVAINRSTTNATSITGLQTSLPAGTYADELSGLLNGGSITVSSTGAVSAFNLPAGAVAVWQFAANESAPVIGNIGTDLGKAGTTLTIDGRGFGSTKGTVFFGTTAVTGSQILQWEDSQIQVTVPAITPGQYNIKVRSASSVDSNSYSSFNLLTGDQVSVRFIINNANTQLGENVYLTGNIAELGNWDPNKAMGPFFNQIIRTYPTWYYDVSVPAGTTLEFKFIKKNGTAVTWEGGANHSFTTPTSGVGTVEVNWQP

SEQ ID NO: 579 - DNA, 5007 bp, Unknown
  Obtained from an environmental sample.
gtgtttaaaaggagagctttaggatttttgctggcttttcttttagtttttacagcagtatttggctcaatgcctatggaatttgcaaaggctgagacagatacagcgccagcgatagccaatgttgttggcaattttcaatccaaacttggagattctgactggaatataaacagtgacaaaacgataatgacatataaaggtaatggcttttatgaatttactaccccagttgcgttacctgcaggtgattatgagtataaagttgctcttaatcattcatgggaaggtggaggagttccttcacaaggtaatttaagctttcatcttgattcagattctgtagtgactttttattacaattacaacacttcaagtattaccgattccacaaaatatacaccaattcccgaagacaagcttccaagacttgtagggactatacagcctgcaataggagcaggtgatgattggaaacctgaaacatcgactgctataatgagagactataagtttaataatgtttacgaatacactgcaaatgttccaaaagggaattatgagtttaaagtgactttagggccctcatgggatataaattatggcttaaatggtgaacaaaatgggccaaatattcctttgaatgtagcctatgatactaagattacattttactatgattcggtttcacataatatatggacagattataatccacctcttacaggacctgataataacatatattatgacgatttaagacatgacacccatgacccattcttccgctcgcctttcggtgcaataaaaacgggagatactgtgacattaagaatacaagcaaaaaatcatgacattgagtcagctaaaatttcttattgggatgatattaaaaaaacaagaatagaagtccctatgtacagaattggtcaaagtcctgacgggaaatatgaatactgggaagttaagttaagctttgaccatcccacaagaatttggtattactttatacttaaagacgggaccaaaactgcttattacggagataacgatgaacaattaggtggcgtaggtaaagccacagatacagaaaataaggacttcgaacttactgtctacgataaaaacttagacacccctgattggatgaaagggtcagtaatgtatcaaatattccctgataggttctttaatggggattcttcaaatgaccatctaaagaaatacagcagaagttttgatcctgttgaatatcatagcaactggtacgagcttccagataatccgaatgataaaaataaactaggatatacaggggatggcatatggtcaaatgacttctttggcggtgatttaaaaggtatagatgataaattggattatttaaaaagccttggaatatcagtcatttatctcaatccaatttttcaatcaccttctaatcacaggtacgatacaaccgattacacaaaaatagacgaactattaggagatttatctacctttaagaagctcatggaggatgcccatgcaaaagggattaaggtaatacttgatggcgtcttcaatcatacaagtgatgacagcatttattttgatagatatggtaaatacttaaacacgggagttttaggtgcttatcaagcatggaaacagggagatcagtcaaagtctccatatggtgactggtatgagataaagcctgacggtacctatgaaggatggtggggatttgacagtttacctgtgataaggcagataaacggcagtgaatataatgtcaaaagttgggcggattttattataaataatcctaatgcaatatctaagtattggttaaatcctgatggggacaaaaatgtaggtgcagatggttggagattagatgttgcgaatgaagttgctcacgatttttgggttcattttagaggtgcaattaatactgtgaaaccgaatgctccgatggttgcagaaaactggaatgacgcttcactggatctgcttggagattcttttaactctgttatgaattatctctttagaaatgcagtaattgactttatattggataaatcatttgatgacggaaatgtggttcacaatcctatagatgcagcaaaactcgaccaaaggcttatgagcatatatgagagatatcctcttccagtgttttattctactatgaatcttttaggttctcatgacaccatgaggatattgacagtatttggatacaactctgcggatgaaaatcaaaattctcaagcagcaaaagaccttgcggttaaaagacttaaacttgctgcaatactgcaaatgggttatccaggcatgccttctatttattacggagatgaagcaggacaatctggcggaaaagacccggacaacagaaggacattcccttggggaagagaagatactgatttgcaaacttttttcaagaaagttgtaaatataagaaatgagaatcaagttttgaaaacaggagaccttgagacactttatgcaaatggcgatgtttatgcctttggaagaagaatcataaatggaaaagatacttttgggaaatcgtatcctgacagtgtagctattgtcgtaataaataaaggtgacgcaaaacaggtttctatagataccactaaatttataagagatggagttgcttttacagatgccttaagtggcaagacatacacggttcaggatggtaaaattgttgtagaagttggatcaatggatggagctatacttatatcagatacaggacaaaatttgacagcacctcagccaataacagaccttaaagcagtctcagggaatggcaaagtagacctttcctggagtgtagtagataaagcagtaagctataatatttaccgttctacagttaaaggtgggttatatgaaaaaatagcttcaaatgttacgcaaattacctatactgatacagaggttaccaatggtctaaagtatgtgtatgctgtaaccgctgtagataatgatggaaatgagagtgctttaagcaatgaagttgaggcatatccagcatttcctattggctgggcgggaaatatgaatcaagtaaatacacatgtaataggtgtaaataatccagttgaagtgtatgctgaagtgtgggctcaagggcttacagataaacctggccaaggagaaaatatgattgcccagttaggatataggtatattggagatactgtaggagatgcagtttacaatgccgtgtacaataaggtagaaggtgttgaaataagtaaggactggacatgggttgatgcacaatatgtaggtgattctggaaataatgataaatacatggctaaatttgtacctgatatggtaggcacatgggaatacattatgagattttcttctaaccaaggccatgattggacgtatacaaaaggaccagatgggaaaacagatgaagcaaaacagtttactgtcgtgccatcaaatgatgtagaaacacctacagctccagtcttacaacaaccaggaattgaatcctcaagagttacacttaactggagtccgtcagctgatgatgttgctattttcggctacgaaatctataagtcttcaagtgagacaggaccatttataaagattgcaactgtgtctgacagtgtgtataactacgtagatacagatgtagtaaatggcaatgtgtattattataaagttgtggcagttgatacctcctataataggacagcatcaaatacagtaaaagcgacacctgatataatacctataaaagtgacatttaatgtcacaataccagattatactcctgatgatggtgtaaatattgctggaaacttcccggatgctttctggaatccaaatgctaatcaaatgacaaaagctggttctaacacctatagtattacacttactttaaatgagggtacacaaattgaatataaatatgcaagggggagctgggataaagtagaaaaaggtgaatacggcaatgagattgacaacagaaaaataactgttgtcaatcagggttcaaatacaatggttgtaaatgatacagtgcaaagatggagagatgtgccaatatatatctattctccaaaagacaagactattgttgatgcaaatacgagtgaaatagagattaaaggcaatacttacaaaggtgcgaaagtaactataaatgatgaatcttttgtgcaacaagaaaatggagtatttacaaaagtagttcccttggaatatggtgtaaatactatcaaaatacatgtagagccaagtggtgacaagaataatgaacttacaaaagatataacaataactgttacaagagagaagcccggccaggagacagaacctactcctactccaccaacagaaacaacaaaaccatctcaagaagtatcacaaggcaaaatagttgtagaaaataacacaacaacacttacaatagacgaaaacaaagtagcaaaagacataaaagacacttcaaagaaagaaatacgatttgacttaacaaatataggaactacacctcaaaaagcattagaaatacctgtaactgtacttaatttaatagcagagaacaacaaaaacgtagtagtaaaatcagacgaagtagctcttcaatttgatgcaaaaactttagcagtatcacaagaagcaattgacctcataaacaaagcaggaacaataaaacttaacatacacaacaaaggcaaaaaggaagcatcatctttcgagccaataacaagtgcctatgacataacaataaaagcaggagacaaagacataaaaatagggtcaccagtaaaaatgacatttaacataaaaggtggaaaagacataagaaaagcaggagtatactacttaaacgagaagacaaatcaatgggaatacgtaggaggaaaaattgacaaaggaacaaacacaataacctttgaagccaaacacttctcaacctatggagtctttgaatacaacaaagaattcaaaaag

SEQ ID NO: 580 - protein, 1669 aa, Unknown
  Obtained from an environmental sample.
  SIGNAL (1)...(29)
  DOMAIN (390)...(821): Alpha amylase, catalytic domain
  DOMAIN (833)...(924): Alpha amylase, C-terminal all-beta domain
  DOMAIN (929)...(1009): Fibronectin type III domain
  DOMAIN (1165)...(1248): Fibronectin type III domain
MFKRRALGFLLAFLLVFTAVFGSMPMEFAKAETDTAPAIANVVGNFQSKLGDSDWNINSDKTIMTYKGNGFYEFTTPVALPAGDYEYKVALNHSWEGGGVPSQGNLSFHLDSDSVVTFYYNYNTSSITDSTKYTPIPEDKLPRLVGTIQPAIGAGDDWKPETSTAIMRDYKFNNVYEYTANVPKGNYEFKVTLGPSWDINYGLNGEQNGPNIPLNVAYDTKITFYYDSVSHNIWTDYNPPLTGPDNNIYYDDLRHDTHDPFFRSPFGAIKTGDTVTLRIQAKNHDIESAKISYWDDIKKTRIEVPMYRIGQSPDGKYEYWEVKLSFDHPTRIWYYFILKDGTKTAYYGDNDEQLGGVGKATDTENKDFELTVYDKNLDTPDWMKGSVMYQIFPDRFFNGDSSNDHLKKYSRSFDPVEYHSNWYELPDNPNDKNKLGYTGDGIWSNDFFGGDLKGIDDKLDYLKSLGISVIYLNPIFQSPSNHRYDTTDYTKIDELLGDLSTFKKLMEDAHAKGIKVILDGVFNHTSDDSIYFDRYGKYLNTGVLGAYQAWKQGDQSKSPYGDWYEIKPDGTYEGWWGFDSLPVIRQINGSEYNVKSWADFIINNPNAISKYWLNPDGDKNVGADGWRLDVANEVAHDFWVHFRGAINTVKPNAPMVAENWNDASLDLLGDSFNSVMNYLFRNAVIDFILDKSFDDGNVVHNPIDAAKLDQRLMSIYERYPLPVFYSTMNLLGSHDTMRILTVFGYNSADENQNSQAAKDLAVKRLKLAAILQMGYPGMPSIYYGDEAGQSGGKDPDNRRTFPWGREDTDLQTFFKKVVNIRNENQVLKTGDLETLYANGDVYAFGRRIINGKDTFGKSYPDSVAIVVINKGDAKQVSIDTTKFIRDGVAFTDALSGKTYTVQDGKIVVEVGSMDGAILISDTGQNLTAPQPITDLKAVSGNGKVDLSWSVVDKAVSYNIYRSTVKGGLYEKIASNVTQITYTDTEVTNGLKYVYAVTAVDNDGNESALSNEVEAYPAFPIGWAGNMNQVNTHVIGVNNPVEVYAEVWAQGLTDKPGQGENMIAQLGYRYIGDTVGDAVYNAVYNKVEGVEISKDWTWVDAQYVGDSGNNDKYMAKFVPDMVGTWEYIMRFSSNQGHDWTYTKGPDGKTDEAKQFTVVPSNDVETPTAPVLQQPGIESSRVTLNWSPSADDVAIFGYEIYKSSSETGPFIKIATVSDSVYNYVDTDVVNGNVYYYKVVAVDTSYNRTASNTVKATPDIIPIKVTFNVTIPDYTPDDGVNIAGNFPDAFWNPNANQMTKAGSNTYSITLTLNEGTQIEYKYARGSWDKVEKGEYGNEIDNRKITVVNQGSNTMVVNDTVQRWRDVPIYIYSPKDKTIVDANTSEIEIKGNTYKGAKVTINDESFVQQENGVFTKVVPLEYGVNTIKIHVEPSGDKNNELTKDITITVTREKPGQETEPTPTPPTETTKPSQEVSQGKIVVENNTTTLTIDENKVAKDIKDTSKKEIRFDLTNIGTTPQKALEIPVTVLNLIAENNKNVVVKSDEVALQFDAKTLAVSQEAIDLINKAGTIKLNIHNKGKKEASSFEPITSAYDITIKAGDKDIKIGSPVKMTFNIKGGKDIRKAGVYYLNEKTNQWEYVGGKIDKGTNTITFEAKHFSTYGVFEYNKEFKK

SEQ ID NO: 581 - DNA, 2142 bp, Unknown
  Obtained from an environmental sample.
atgaaaaagttttacaaactgacaaccgctcttgcccttagcttgtccctagcgttgagccttctcggccctgctcatgcggccccggatacttcggtgtccaataagcaaaattttagcacggatgtcatttatcaaatctttacggatcgtttctccgacggcaatgctgccaacaacccgaccggacctgcctttgacggtacctgtaccaatctgaggctgtactgcggcggcgactggcaagggatcattaacaaaatcaacgacggctacctgaccggcatgggcgttaccgccatctggatctcccagcctgtcgaaaacatttacagcgttatcaactattccggcgtgagcaacaccgcttatcatggctattgggccagagacttcaagaaaacgaatccggcttacggcacgatcgccgatttccagaatctcatcgcagccgctcatgcgaagaacatcaaagtcatcatcgacttcgcaccgaaccatacctctcccgcttcctcggaccagccttcattcgcggagaacggcaagctgtacaacaacggcaccctgctcggcggatacacgggcgatacacagaatttgttccatcataacgggggcaccgatttttcaacgacagagaacggaatttacaaaaacctgtacgaccttgctgacctgaaccacaacaacggcaccgtggatacctacctgaaggatgccatcaaaatgtggctcgatctgggcattgacggcattcgaatggacgcggtgaaacatatgccgtttggctggcagaagagtttcatggccaccgttaacaactataagccggtcttcaccttcggcgaatggttcctcggcgtgaacgaagtgagtgcggagaaccataagttcgccaacgaatccggcatgagcctgctggacttccgtttcgcgcagaaggtacgccaggtattcagggacaataccgacaatatgtacggtctgaagtccatgctggagggctcggcaaccgactatgcccaagtggaggatcaggtcacattcattgataaccatgacatggaacgtttccacgataacagcgccaaccgccggaagctggaacaggccttggccttcacgctcacctcacgcggggtgccagccatctattacggaaccgaacaatacatgtccggcgggaacgatcctaacaaccgggcacggattccttcattctctacgacgactaccgcttaccaagtaattaaaaagctcgcgccattgcgtaaatccaatccggccatcgcctatggaacgacgcaggagcgctggatcaacaatgatgtgctgatctatgaacgcaaattcggcagcaacgtagcgcttatcgctgtaaaccgcaacgtgaacacgccggcttccattaccggattggcgacttcattgcctgccggcagctatgccgacgtgctgggcggtctcctgaacggtaacagcctgaccgttggcacaggcggagcagcttccaactttacgctggctgccggcggtacggccgtatggcaatataccacggccgtgacttcgccaacgatcgggcacgtaggcccgatgatggccaaaccgggcgcaaccgtcaccattgacggccgcggcttcggcgcaaccaaaggcacggtatacttcggctcaacggccgtaacgggcgctaacattacggcatgggaggacacgcagatcaaagtgaagatccctgcggttgccggtggcgtatataacattaaagttgccaatatcgctggcacttcaagcaatgtgcacgacaacttcgaagtactgaccggggatcaagtcagtgtccggtttgtggtgaacaatgccaccaccgcactcggacaaaacgtgtacctggcaggcagcgtaagcgagctgggcaattgggacccggccaaagccatcggtccgttgtacaaccaggttatctaccaatacccaacttggtactacgacgtcagcgtaccggccggtaaaaccatcgaattcaaattcctgaaaaagcagggctcgacggtaacgtgggaaggcggatcgaaccatacctttaccgcaccaacgagcggcacggccacgattaatgtaaactggcagccgtaa

SEQ ID NO: 582 - protein, 713 aa, Unknown
  Obtained from an environmental sample.
  SIGNAL (1)...(27)
  DOMAIN (46)...(425): Alpha amylase, catalytic domain
  DOMAIN (526)...(609): IPT/TIG domain
  DOMAIN (613)...(709): Starch binding domain
  DOMAIN (437)...(521): Alpha amylase, C-terminal all-beta domain
MKKFYKLTTALALSLSLALSLLGPAHAAPDTSVSNKQNFSTDVIYQIFTDRFSDGNAANNPTGPAFDGTCTNLRLYCGGDWQGIINKINDGYLTGMGVTAIWISQPVENIYSVINYSGVSNTAYHGYWARDFKKTNPAYGTIADFQNLIAAAHAKNIKVIIDFAPNHTSPASSDQPSFAENGKLYNNGTLLGGYTGDTQNLFHHNGGTDFSTTENGIYKNLYDLADLNHNNGTVDTYLKDAIKMWLDLGIDGIRMDAVKHMPFGWQKSFMATVNNYKPVFTFGEWFLGVNEVSAENHKFANESGMSLLDFRFAQKVRQVFRDNTDNMYGLKSMLEGSATDYAQVEDQVTFIDNHDMERFHDNSANRRKLEQALAFTLTSRGVPAIYYGTEQYMSGGNDPNNRARIPSFSTTTTAYQVIKKLAPLRKSNPAIAYGTTQERWINNDVLIYERKFGSNVALIAVNRNVNTPASITGLATSLPAGSYADVLGGLLNGNSLTVGTGGAASNFTLAAGGTAVWQYTTAVTSPTIGHVGPMMAKPGATVTIDGRGFGATKGTVYFGSTAVTGANITAWEDTQIKVKIPAVAGGVYNIKVANIAGTSSNVHDNFEVLTGDQVSVRFVVNNATTALGQNVYLAGSVSELGNWDPAKAIGPLYNQVIYQYPTWYYDVSVPAGKTIEFKFLKKQGSTVTWEGGSNHTFTAPTSGTATINVNWQP

SEQ ID NO: 583 - DNA, 6618 bp, Unknown
  Obtained from an environmental sample.
atgatggctgtgtcaaaaaaagaaatcacccaagacatgttccagccggcggtcatcgataaaagcctgcaagaacaagtttccggaccgagcatcggcttttggagcgacggtttccggcgcctgcgcaaaaataaagcggcgatggtgagcgcgttcattatcctgctcatcgtcatcatggcgctcgtcgggccgcacatgagcaaatacggcatcgatgaccaagacttgaaacgctcgaacttaccgccgcgcatttccgcattggccaacattcattggctgccttttgacggcaaaaacgaacaaggcgtcgacgtttacaaagagcgcggcatcaaacaagatttgtggtttggcgcggacaaactcggccgcgacctgtggacacgggtttggaaaggcacgcaaatttccctcttcatcgccgtcgtcgccgctgcggccgacctgattatcggcgtcgcttacggggggatttccgcctatttcggcggccaggtcgacaacatcatgcagaggatactcgaagtgctcaatggcattcccaacctggtgatcatcatattgttaatcatcgtcatgcaaccgggcatacccgcgatcatcctggcgatcgccatgaccggttggatcggcatggcgcggatcatacgcggagaagttttaaaacttaaaaatttggaattcaagctgaccaagaacggcagctacgcgtccggcattccgggagacggggaaaatttgaagctgacgctcagccaggccgccaaggtgaatttttatgtaaacggggacacgcaagaagcccgaatatcgccgctgccggagggatcgaccgcgagcggcattcagatctacaacccgattttgtccgcggataagtggccgcgtctggtcggttcgttgcagccgctattcggcgagcccgaatggtcgccgggagaggccaagcagttttttgtcgattataacttcaacaataccgtgtataagcttcagcgctcgcttccggcaggctcgtacgaggcgaaggtcgtgctgggcgcggattgggcggacggcaacaacttcggaaacggaaacgccaacgccgcattcagactcccggacgccgcggatgtgaccttttccttcgacaattcggcggctgagaggaaactcacggtcgattacgcggtcggagacggcaagtatgacggcaaaatcgatgcgggcgcgattgcgttcgacagccggcaggcaacgttcaaaaagccgttcggcgccatcaagcaaggcgagcaggacttgacgctgcgcatcgccgtcaaacgcgacgacgtgcagatggcccgggtggagctgaccgacgcccatggcgcggcgaccaactatgtgatgcgcaaaacgacgacagtcggggatcgcgattattacgaagcggtcattccgaaaagcgtttttgccggcattggcatctggggttataaattcgtgctgatcgacggggcggcgaaggtcgaatacggcgacgacagtctcagcggcggctcgggcgaggcggtggcggacggcgcggttccgtttaacctgacggtgtacgcggcggactacaaaacgccggattggatgaaaacggccgtcgtgtatcagatttttcccgaccgcttctttgacggcaatccggacaacaaccgcgcgaagctggccgacggttaccggggcgttcgcagcgagaccggggaacaagccgggcgcatcggcaaacaggagctgcaatatttcgacggaggcgtagcgaacgatccggctccttcgcaggtatggggcgattggaacgacccgccggagaacccggaccgcaccaagccggaaaacaagccttattatccggacgcgaagtcggacggcatctggacgaacgagttttacggcggggacattcagggcatcgagcagaagctcgactatctgaagcagcttggcgtcacggcgatttacctcaatcccgtcgcctgggcggcttccaaccataaatacgatgcgaccgactacaagcatctcgatccgatgttcggcgaaccggtatacaacacgcccggcgacccgtcttccggattgaattacgaggagacccggaaaaagtcggacgaagtgtaccggaaattcgccaaggcggcagccgaggccgggattcggatcatcaacgacggcgtgttcaaccatgtcggggacgactccatttatttcgaccgttacgagaaatatccggaaatcggcgcctacgagtattggtcgaaggtgtggaagacgaaggccgaacatccgggcatgacccgcgaggaggccgagcagcgcgtcatcgcttcgtacacgagccaaatcaatccggcaaccgggcggcattaccaatatccggacgatttcggcttcaccacgtggtttacgatcggcgaaaatatggcggacaatacccgttacagctacgacgcctggtggggattcgactcgctgcccgccatggacgccaaggaaccgcagccgggcgataaagacgcgctcgaaggcgttcacgaatggaacaatatcgactaccgcaatcatgtcatcgggtatgatctcagcggcaaatcggaggccgaagcgtccgcagcgatgcaaaacacggcgtcgcagcgatggctgtggatgggctcgagcggctggcgtctcgacgtggcgccggacgtgtcggcaggcacgtggcggaaattccgcgaggcggtcaaatccgcggcgggacgaacggacgcaaacggcaagccgatcgacgatccggtcattctcggcgaagagtggggcgtggcaacgcattatttgctcggggaccagtttgactcgatcatgaactaccggttccgcgaagccgtgcaaaacttcatcatcggcggcggcaatggcgggaacaatgcgttggcgttccacgaagccctcgaacggatccgcgaggattatccggaggaagcgtggaaggtcatgctgaacctcgtcgattcccacgataccgttcgctcgctgacgaagctggattatccgtcgtgggaagaagagaaactgaagatcgcgccggaagcgagcgacaaggcgctgaagcagcaggctttgatcgcgatattccaaatgggttatccgggcgccccgacgatttattacggcgacgaagtcggcgtaaccggcacgaaggacccggattcgcgcaggacgttcccgtgggagcggatcgaaagctccggcggctcctacaaggcggccggacgttatgcggaattgtatgagacgtacaaaaaggccgcagccacgcgggccgcaaacgacgtcttcgcgaccggggagctcaagctcgtctacgcgcagggagacacgatcgcttacgcccggaaaaatgcggcgaaaggcgcgcttgtcgtcatcaacagcggcggcgagacggccgagatgacggcggatgtggccggatttttgccggacgggacgaagctgagcgaccagcttggcagcggcatttccggcaccgtcgagaacggccgcattgccctgtccgtcccggcgctgaccggactcatgatgctgtccgacggcgcgctgatttcggtcgattcgccggacggcttgaaggcgcaagccggaaacggcagcgtggcgcttagctggaacggggtggcggatgcacaggcgtaccgcgtttaccggtcgctggtggagggcggcgaagcgacgctgctcggaacggttacggaaacgcagttcacggatacttcggtcaccaacggcgtgaagtattattatggggtaacggcggtccgtacgacggcggacggggccggcgaaagctcgctgcaggagatggtcgcggcgaccctcgcatttccggtaacggccgtcgggaacccgacccaggccgaaaacatgacgatcggcgtcggcaactcggccgacatcggcgtggcggtcacggttgcgggcttgacggacgacccttcgcttgccgggcgggaagcgccgcgattgagcgtgaagctgatcgtggccaagtcggacgcttcggaacctgttgccgagctttcgatggcgtacaaggcggacgaaggagacgccaagcggtacgcggccaagttcgagccgaccgaagcgggcgtatacaactatttcgtccgggtgtcgacggataacgaagagacgtttacggattcggcgacggcttcgttcgaggcttatgcggacccgaacgatacgatgggacccgaggcgcctatcttaagcgaaatcacggtcgaatccggtcaggcggcgttgaactggacgccggcgggagaagagacgtcgggctacgaggtgtaccggaaggcggcgggggaagcgacgttccgcaagctggccacgctgcggacggccacttcctatatcgattacacggtgacgaacggcacttcctacacgtacaaaatcgcggccttcgacgcggcttacaaccggggctggtcgaacgagcagaccgttacgccgcaactggtgatggtcgacgtgacgctgcggctgcatttgccggattacacgccggcgacggactcgatttatattgcgggaaccttgaacaactggaacgcgagcggcggcaagctgaccgtgccgagcggcgcgaccggccgcagcgtcgtccaatatgccttcaagatgatggccggcaagacgatcgaatacaagtacacgcgcggcacatgggcgacggaagcactgaccagccatgcgcgggtcccgaacgatacgacggatgtgagcaactacgcgtacagcgacgaaaaaaccaatatgaagctgacgatccgcaatcagggcggcggcaaaatgatcgtcgacgactacgtgctgcgctgggcggatatgccgatgatcgtcacgatgccgcggatttcgtacggcgaggatatcgcgttcgccacgtccgacagcgccttcgatctgaaggcgaacgttccgtacggcgtcgcgttcacgatcaacggccagccgctgccgaaaggcgccatggacgaccggggcaacgtctacgtggaaaaaattccgctgaagccgggagagaatacgttcatcctccatatcgaaccgacggcggagacgctggcgcaggaatggtataaggatcaaggccgcaaaggccaggcgaccaagtcgattgcgctacgcattacgagaaccgccggagacggcggcggtggggacgacggagatggcggtaacggtggtagcggcggagacggcggcaacggcggagatggcggtaatggcggtgacggcggcaatgggggcgatggtcccggcactccggttgtcatcgtgcctttgccctccgctccttccggatcgcttgtggcccgacgggacaccgaaacggatgggcagggcaacacggttaccgtcgcgacagtggacggcgagaagctggcggcggccatcgccgctttgaaggacggcaatggcgtggtcgagatccggcttccggatacgaagggcagcgtccggttcgcgattccgctgaaagcggcggctgcggggaaagccgcgtctccggccgcagccgttcgcttggcgaccgcagacggcagctatgcgttgccgctgtccgtcctcgagccggaggagcttgcgaaaaagctgggcgtttccgtcgaagacgtcacgcttacggtgagcataagcgtgctaacaggagcggaagccgagcgggcgcaagcgctcgtcgaggcggcgggcgcgaaagtgctgggcggtccgatcgcgtatacggtcgtcgcctcggccggcgaacgcgaaacggagctggcgagcttcggttccgtttacgcggagcggagcatgacgctgaagggcgtcgtcgatccgcggcatgcctcggtgttccgggttgacgacgaggcgaacaagctgagcttcgtgcccgctttgtttacggcggccggcaacgggcaaaccgccgtcgcgttcaagcggccgggcaacagcgtctacatcgtcgcttcctcggaacgcgactttgcggatgtcgcggatcattgggcgcggccggatatcctgctccttgccaacaagggcatcgtccaaggtgtccaggacggcttgttcgctcccgaccggcgcatcacgcgcgcggagttcgcgtcgctgcttgtccgctcgctcggcatggccgaagcggacggaaccggcggattccgcgacgtccggccggacgattggtttgccggcgtcgtggcggcagcggcgaaagcggggcttgtgaacggaacggaagacggctcgttccggcccggcgacggcatcacgcgggagcagatggccgtcatggccgcgaaggcgctcgccttcgccggcaaaccggctgcgggcggagcgccgcaggcgggcgaaacgcttgccgcgttcgccgacggcgcggccgtcagcgcctgggcgcgggatgccgtcgcccggaccgtgcaggccggcctcatgcagggcggcagcggcggccggctcgcgccgtccgaaggcgcgacgcgagcgcaggcggttgtgatgctgaagcgcctgctggagacgttggcgtttatcgacaagtga

SEQ ID NO: 584 - protein, 2205 aa, Unknown
  Obtained from an environmental sample.
  DOMAIN (546)...(1109): Alpha amylase, catalytic domain
  DOMAIN (2018)...(2059): S-layer homology domain
  DOMAIN (2077)...(2119): S-layer homology domain
  DOMAIN (2147)...(2190): S-layer homology domain
  DOMAIN (1125)...(1203): Alpha amylase, C-terminal all-beta domain
  DOMAIN (1421)...(1502): Fibronectin type III domain
  DOMAIN (1206)...(1286): Fibronectin type III domain
MMAVSKKEITQDMFQPAVIDKSLQEQVSGPSIGFWSDGFRRLRKNKAAMVSAFIILLIVIMALVGPHMSKYGIDDQDLKRSNLPPRISALANIHWLPFDGKNEQGVDVYKERGIKQDLWFGADKLGRDLWTRVWKGTQISLFIAVVAAAADLIIGVAYGGISAYFGGQVDNIMQRILEVLNGIPNLVIIILLIIVMQPGIPAIILAIAMTGWIGMARIIRGEVLKLKNLEFKLTKNGSYASGIPGDGENLKLTLSQAAKVNFYVNGDTQEARISPLPEGSTASGIQIYNPILSADKWPRLVGSLQPLFGEPEWSPGEAKQFFVDYNFNNTVYKLQRSLPAGSYEAKVVLGADWADGNNFGNGNANAAFRLPDAADVTFSFDNSAAERKLTVDYAVGDGKYDGKIDAGAIAFDSRQATFKKPFGAIKQGEQDLTLRIAVKRDDVQMARVELTDAHGAATNYVMRKTTTVGDRDYYEAVIPKSVFAGIGIWGYKFVLIDGAAKVEYGDDSLSGGSGEAVADGAVPFNLTVYAADYKTPDWMKTAVVYQIFPDRFFDGNPDNNRAKLADGYRGVRSETGEQAGRIGKQELQYFDGGVANDPAPSQVWGDWNDPPENPDRTKPENKPYYPDAKSDGIWTNEFYGGDIQGIEQKLDYLKQLGVTAIYLNPVAWAASNHKYDATDYKHLDPMFGEPVYNTPGDPSSGLNYEETRKKSDEVYRKFAKAAAEAGIRIINDGVFNHVGDDSIYFDRYEKYPEIGAYEYWSKVWKTKAEHPGMTREEAEQRVIASYTSQINPATGRHYQYPDDFGFTTWFTIGENMADNTRYSYDAWWGFDSLPAMDAKEPQPGDKDALEGVHEWNNIDYRNHVIGYDLSGKSEAEASAAMQNTASQRWLWMGSSGWRLDVAPDVSAGTWRKFREAVKSAAGRTDANGKPIDDPVILGEEWGVATHYLLGDQFDSIMNYRFREAVQNFIIGGGNGGNNALAFHEALERIREDYPEEAWKVMLNLVDSHDTVRSLTKLDYPSWEEEKLKIAPEASDKALKQQALIAIFQMGYPGAPTIYYGDEVGVTGTKDPDSRRTFPWERIESSGGSYKAAGRYAELYETYKKAAATRAANDVFATGELKLVYAQGDTIAYARKNAAKGALVVINSGGETAEMTADVAGFLPDGTKLSDQLGSGISGTVENGRIALSVPALTGLMMLSDGALISVDSPDGLKAQAGNGSVALSWNGVADAQAYRVYRSLVEGGEATLLGTVTETQFTDTSVTNGVKYYYGVTAVRTTADGAGESSLQEMVAATLAFPVTAVGNPTQAENMTIGVGNSADIGVAVTVAGLTDDPSLAGREAPRLSVKLIVAKSDASEPVAELSMAYKADEGDAKRYAAKFEPTEAGVYNYFVRVSTDNEETFTDSATASFEAYADPNDTMGPEAPILSEITVESGQAALNWTPAGEETSGYEVYRKAAGEATFRKLATLRTATSYIDYTVTNGTSYTYKIAAFDAAYNRGWSNEQTVTPQLVMVDVTLRLHLPDYTPATDSIYIAGTLNNWNASGGKLTVPSGATGRSVVQYAFKMMAGKTIEYKYTRGTWATEALTSHARVPNDTTDVSNYAYSDEKTNMKLTIRNQGGGKMIVDDYVLRWADMPMIVTMPRISYGEDIAFATSDSAFDLKANVPYGVAFTINGQPLPKGAMDDRGNVYVEKIPLKPGENTFILHIEPTAETLAQEWYKDQGRKGQATKSIALRITRTAGDGGGGDDGDGGNGGSGGDGGNGGDGGNGGDGGNGGDGPGTPVVIVPLPSAPSGSLVARRDTETDGQGNTVTVATVDGEKLAAAIAALKDGNGVVEIRLPDTKGSVRFAIPLKAAAAGKAASPAAAVRLATADGSYALPLSVLEPEELAKKLGVSVEDVTLTVSISVLTGAEAERAQALVEAAGAKVLGGPIAYTVVASAGERETELASFGSVYAERSMTLKGVVDPRHASVFRVDDEANKLSFVPALFTAAGNGQTAVAFKRPGNSVYIVASSERDFADVADHWARPDILLLANKGIVQGVQDGLFAPDRRITRAEFASLLVRSLGMAEADGTGGFRDVRPDDWFAGVVAAAAKAGLVNGTEDGSFRPGDGITREQMAVMAAKALAFAGKPAAGGAPQAGETLAAFADGAAVSAWARDAVARTVQAGLMQGGSGGRLAPSEGATRAQAVVMLKRLLETLAFIDK

SEQ ID NO: 585 - DNA, 1860 bp, Bacteria
atgtccctattcaaaaaaagctttccgtggattttatccctacttcttttgtttttgtttattgctcctttttccattcaaacagaaaaagtccgagctggaagtgtgccggtaaacggcacaatgatgcaatatttcgaatggtaccttccagacgatggaacactatggacgaaagtagcaaataacgctcaatctttagcgaatcttggcattactgccctttggcttccccctgcctataaaggaacaagcagcagtgacgttggatatggcgtttatgatttatatgaccttggagagtttaatcaaaaaggaactgtccgaacaaaatacgggacaaaaacacaatatatccaagcaatccaagcggcccatacagcagggatgcaagtatatgcagatgtcgtctttaaccataaagccggtgcagatggaacagaactagttgatgcagtagaagtaaatccttctgaccgcaatcaagaaatatcaggaacatatcaaatccaagcgtggacaaaatttgattttcctggtcgtggaaacacctattctagttttaaatggcgttggtatcatttcgatggaacggactgggatgagagtagaaaactaaatcgtatttacaagttccgcggcacgggaaaagcatgggattgggaagtagatacagaaaacgggaattatgactatctcatgtatgcagatttggatatggatcatccagaggttgtatccgaactaaaaaattggggaaagtggtatgtaaccacaaccaatatcgacggattccgtctggatgcagtgaagcatattaaatatagctttttcccggactggctatcgtacgtacgaacccaaacacaaaagcctcttttttccgttggggaattttggagctatgacattagcaagctgcacaactatattacaaagacgaacggctctatgtccctattcgatgccccgctgcataacaatttttatatagcatcgaaatcaggcggttattttgatatgcgcacattactcaacaacacattgatgaaagatcagcctacattagcagtcacattagtggataatcacgatactgagccagggcaatctttgcagtcatgggtcgagccatggtttaaaccgttagcttacgcatttatcttgacccgccaagaaggttatccttgtgtcttttatggagattactatggtattccaaaatacaacattcctgcgctgaaaagcaaacttgatccgctgttaattgccagaagagattatgcctatggaacacagcacgactatattgacagtgcggatattatcggttggacgcgggaaggagtggctgaaaaagcaaattcaggactggctgcactcattaccgacgggcctggcggaagcaaatggatgtatgttggaaaacaacacgctggcaaaacgttttatgatttaaccggcaatcgaagtgatacagtgacaatcaatgctgatggatggggagaatttaaagtcaatggagggtctgtatccatatgggttccaaaaacatcaaccacttcccaaataacatttactgtaaataatgccacaaccgtttggggacaaaatgtatacgttgtcgggaatatttcgcagctggggaactgggatccagtcaacgcagttcaaatgacgccgtcttcttatccaacatgggtagtgacagtccctcttccacaaagtcaaaacatacaatttaaatttatcaaaaaagatggatcaggaaatgtcatttgggagaatatatcgaatcgaacatacaccgtcccaactgctgcatccggagcatatacagccagctggaacgtgccctag

SEQ ID NO: 586 - protein, 619 aa, Bacteria
  SIGNAL (1)...(28)
  DOMAIN (521)...(614): Starch binding domain
  DOMAIN (40)...(425): Alpha amylase, catalytic domain
MSLFKKSFPWILSLLLLFLFIAPFSIQTEKVRAGSVPVNGTMMQYFEWYLPDDGTLWTKVANNAQSLANLGITALWLPPAYKGTSSSDVGYGVYDLYDLGEFNQKGTVRTKYGTKTQYIQAIQAAHTAGMQVYADVVFNHKAGADGTELVDAVEVNPSDRNQEISGTYQIQAWTKFDFPGRGNTYSSFKWRWYHFDGTDWDESRKLNRIYKFRGTGKAWDWEVDTENGNYDYLMYADLDMDHPEVVSELKNWGKWYVTTTNIDGFRLDAVKHIKYSFFPDWLSYVRTQTQKPLFSVGEFWSYDISKLHNYITKTNGSMSLFDAPLHNNFYIASKSGGYFDMRTLLNNTLMKDQPTLAVTLVDNHDTEPGQSLQSWVEPWFKPLAYAFILTRQEGYPCVFYGDYYGIPKYNIPALKSKLDPLLIARRDYAYGTQHDYIDSADIIGWTREGVAEKANSGLAALITDGPGGSKWMYVGKQHAGKTFYDLTGNRSDTVTINADGWGEFKVNGGSVSIWVPKTSTTSQITFTVNNATTVWGQNVYVVGNISQLGNWDPVNAVQMTPSSYPTWVVTVPLPQSQNIQFKFIKKDGSGNVIWENISNRTYTVPTAASGAYTASWNVP

SEQ ID NO: 587 - DNA, 4111 bp, Thermomyces lanuginosus ATCC 200065
  CDS (702)...(942): Exon
  CDS (1007)...(1290): Exon
  CDS (1352)...(1447): Exon
  CDS (1528)...(2166): Exon
  CDS (2224)...(2817): Exon
tccaaagaattgaacgtcgtcggatgatcgtgatggtcagttttgaggtatcttccgaagagccaatttggattacccggcagtccggcagtccgacggtccagacaaggatcaatcagggcctggcactattttagcatgtcggttagtccccaatcggctctgcatttgacagcggacatctgccgatcaggaacgaaacggtgcctgccgttgttgccctgtgagctctttatgcatgtcaattcataataatcccgataataggccgcagctattccaccctggggaaagggtttgttgaatgtcggcgatttggggtacatctgggggttcggcacttcagtgtctccaggtccgaatttcatgcattcatgcatgaaaatgcggagggaacctcggcactgtcaccatccccgtcaaactacggcttttggcgggctacattggctacaatggccacaatggctacaacggcctgtcaaggtatccattaatttctccgaagctcctgcaacgtttcgacaccctaaatttccgtttccgctacggagagcggagtaccggatactttttggacttttcatgtgcttctgtcgggcattcaaagaccgggcctgtcctaacgtccaggggatcgtttggcagatcttccctcatgcgttcacagagcgaagtttgtttaattgagtcatcaaaacatgttattccaaccgactttgtgcgcggcccttggactcgccgccttgatcgtccaaggcggagaagccagacctgaaacaaccgtcccacatgcaacgggctcgctcgacgacttcctcgccgcacagagtccgattgctttccaaggcatcctgaacaatatcgggcctagcggagcgtactcggaaggtgtcaatccgggtgtggtcattgcgagtccaagtaaacaagatcccgactgtatgcctgctctggaaatttttcaattctgttggcaggactctctctctaatatggcacatagacttttacacctgggtgcgcgacgctgctctcactgtccaatatctggtggaggagctggttgcaggaaatgccagtcttcagttcctcattcaggactacatcagctcccaggcacgactgcagacggtggaaaatccatccggctccctctcgtcgggtggtctaggagagcccaagtttcatgtcgacgagaccgcctttacggactcctggggccgaccacagcgggacggcccgcctctccgcgccattgccatgatttcgtttgccaattacctgattgtaagtcagatttcccatcatgcgagtaaattgacatggatgtgctcagtgtagttttcaggacaacggtcatcaatcgactgtggaggacatcatctggccgattgttcgcaatgacttgtcctatgtctcgcagcattggaacgaaacaacttttggtatgtgcttacgccgtactagttgattggagagtttggattataggagagcctcaagctaatacggagtttttccgaagacatctgggaggaagtccatagctcatcgtttttcaccacggctgtccagtaccgtgctctggtccaaggcagtgccttggctagcaagctcggccatacctgcgacaactgcgggtcccaagcaccgcagatcctttgcttcctgcagtcgtattggaccgggtcgcacatcttagccaacaccggtggcggccgctcgggaaaggacgtcagcacgatcctcggcgtcattggctcgtttgatccgaacgccgactgtgatgacgttaccttccagccctgctcggcccgggctcttgcaaatcacaagcaggtcgttgacagcttccgcagtatctatgccatcaacgctggcatcccgtcagggtcggctgttgcggttggacgttatcccgaggatgtctatcagggtggacacccctggtacctaacaacggctgcggcggcggagcagctttacgacgccatttaccagtggaaccatgtagggcacatcgacatcaatgctgtcaatctggacttcttcaagagcatttatccgtcagccgccgagggcacatacacatcagactcttcaacatttcaagacattatatctgctgtacggacctatgcggacgggtttctcagcgtaattgtaagtccaaaccttcgaaaacgaatgcctcaagtcttccactgacattttgcgcaggagaaatacactccgccggataacttgcttgccgagcagttccaccgggagacgggcattccactatcggcagcttctctgacatggtcctacgccgcgctcaacacggccgcgcagcggcgagcgtcaatcgtgccctcaccgtggaactctaacagcacagatctcccggacaaatgctcggcaacctcggcaacagggccgtatgccacgcccacaaacacggcatggccaaccactacgcagccaccggagcggccggcatgcacaccgccgtcggaagtaacactcaccttcaacgcgctcgtcgacaccgcgtttggccagaatatttatctcgtgggctccattccggagctcggatcgtgggatccggccaacgccctcttgatgagcgcaaagagctggactagcggaaatccggtctggacgctatccatttcccttccagcaggaacctcttttgagtacaagttcattcgaaaggatgatggttcctcggatgttgtctgggaaagtgacccgaatcgttcgtacaacgtgccgaaggattgcggtgccaacacggccaccgtgaattcttggtggcgatgaaccaacttgtttctgtccacactccgccctgttgtcagttcctggtcgtagatcgataaaatatgacttgtgtacttgacaaagaaatgatgtaaaagcgttctgttatgtagtaggttagcacttttccctagtagggagtactccgtaggtatgccgataccgaactccgaccggagtaaaactaacgtgtcgagtatcgcgatgttgcgcgtggggagtaaggacgattagggctgaatgctgcagatcctttccttcaccgtctcagagacacggagtcaggtttgaccatggccgcggtgtgaagctgttgatgctcattttcctgtccaatatttcaaggacaacgttgccaacatcaatcccagcaatgagtcctcgtgttgactgtgctgccctgggatcagagacttcgggaatacattgaagttagcaaaacaatgccgtccactaactatgtgcgctcacgtctaccaagtgcacgatccgttctgtggaaggggaagttatcctggtacaggcttgcttgcgattctggatcgactgcgaaaaaaagaggggacatgcgtctggaaagttgcgattcaaaacgatgtcatcagctcattgcctcttgaaatcctgctcgagatcagagattatcttgaactaaacgatattctccgaagccggatggtgcgtatcgtcttgttgctcgatgttgaaagagacatttttatttgacaggagcaaacgtccgaacaagtctcgaaacaatagcgctctattttctcaagcggtccagtcatgagaccttttctgcgggaggctcttgcgctcctggacatgaaaggcacggagatatccgccacggacgttatggcttattttcgatggtacggtggattgaaatatggaaagccagtaaagaaaatgtttctcccatggccagaaggccggataagattggagcaaaggattgagatttattcgcggcggctatattatcatgaatggaagaagagagcagtcggaatgttggatctggaaactagaaagaggcggctttggcccgcaaacgataacacgtactttgaattctttgcatctgatcgatatcttttgatctcggggtaagttgaggacaggatagtagattcctgttggctcgacaggtcgtctaactgcagtgctaggaaacgtctgattgcgtgggatatacaggagtcgcggaaagttggggagattagtggtgagccctggcaggtgaacatcgtgcaggataaggtcgtcatgtttgaacgaaagtcaa

SEQ ID NO: 588 - protein, 80 aa, Thermomyces lanuginosus ATCC 200065
MLFQPTLCAALGLAALIVQGGEARPETTVPHATGSLDDFLAAQSPIAFQGILNNIGPSGAYSEGVNPGVVIASPSKQDPD

SEQ ID NO: 589 - protein, 95 aa, Thermomyces lanuginosus ATCC 200065
YFYTWVRDAALTVQYLVEELVAGNASLQFLIQDYISSQARLQTVENPSGSLSSGGLGEPKFHVDETAFTDSWGRPQRDGPPLRAIAMISFANYLI

SEQ ID NO: 590 - protein, 32 aa, Thermomyces lanuginosus ATCC 200065
DNGHQSTVEDIIWPIVRNDLSYVSQHWNETTF

SEQ ID NO: 591 - protein, 213 aa, Thermomyces lanuginosus ATCC 200065
DIWEEVHSSSFFTTAVQYRALVQGSALASKLGHTCDNCGSQAPQILCFLQSYWTGSHILANTGGGRSGKDVSTILGVIGSFDPNADCDDVTFQPCSARALANHKQVVDSFRSIYAINAGIPSGSAVAVGRYPEDVYQGGHPWYLTTAAAAEQLYDAIYQWNHVGHIDINAVNLDFFKSIYPSAAEGTYTSDSSTFQDIISAVRTYADGFLSVI

SEQ ID NO: 592 - protein, 197 aa, Thermomyces lanuginosus ATCC 200065
EKYTPPDNLLAEQFHRETGIPLSAASLTWSYAALNTAAQRRASIVPSPWNSNSTDLPDKCSATSATGPYATPTNTAWPTTTQPPERPACTPPSEVTLTFNALVDTAFGQNIYLVGSIPELGSWDPANALLMSAKSWTSGNPVWTLSISLPAGTSFEYKFIRKDDGSSDVVWESDPNRSYNVPKDCGANTATVNSWWR

SEQ ID NO: 593 - DNA, 1854 bp, Thermomyces lanuginosus ATCC 200065
atgttattccaaccgactttgtgcgcggcccttggactcgccgccttgatcgtccaaggcggagaagccagacctgaaacaaccgtcccacatgcaacgggctcgctcgacgacttcctcgccgcacagagtccgattgctttccaaggcatcctgaacaatatcgggcctagcggagcgtactcggaaggtgtcaatccgggtgtggtcattgcgagtccaagtaaacaagatcccgactacttttacacctgggtgcgcgacgctgctctcactgtccaatatctggtggaggagctggttgcaggaaatgccagtcttcagttcctcattcaggactacatcagctcccaggcacgactgcagacggtggaaaatccatccggctccctctcgtcgggtggtctaggagagcccaagtttcatgtcgacgagaccgcctttacggactcctggggccgaccacagcgggacggcccgcctctccgcgccattgccatgatttcgtttgccaattacctgattgacaacggtcatcaatcgactgtggaggacatcatctggccgattgttcgcaatgacttgtcctatgtctcgcagcattggaacgaaacaacttttgacatctgggaggaagtccatagctcatcgtttttcaccacggctgtccagtaccgtgctctggtccaaggcagtgccttggctagcaagctcggccatacctgcgacaactgcgggtcccaagcaccgcagatcctttgcttcctgcagtcgtattggaccgggtcgcacatcttagccaacaccggtggcggccgctcgggaaaggacgtcagcacgatcctcggcgtcattggctcgtttgatccgaacgccgactgtgatgacgttaccttccagccctgctcggcccgggctcttgcaaatcacaagcaggtcgttgacagcttccgcagtatctatgccatcaacgctggcatcccgtcagggtcggctgttgcggttggacgttatcccgaggatgtctatcagggtggacacccctggtacctaacaacggctgcggcggcggagcagctttacgacgccatttaccagtggaaccatgtagggcacatcgacatcaatgctgtcaatctggacttcttcaagagcatttatccgtcagccgccgagggcacatacacatcagactcttcaacatttcaagacattatatctgctgtacggacctatgcggacgggtttctcagcgtaattgagaaatacactccgccggataacttgcttgccgagcagttccaccgggagacgggcattccactatcggcagcttctctgacatggtcctacgccgcgctcaacacggccgcgcagcggcgagcgtcaatcgtgccctcaccgtggaactctaacagcacagatctcccggacaaatgctcggcaacctcggcaacagggccgtatgccacgcccacaaacacggcatggccaaccactacgcagccaccggagcggccggcatgcacaccgccgtcggaagtaacactcaccttcaacgcgctcgtcgacaccgcgtttggccagaatatttatctcgtgggctccattccggagctcggatcgtgggatccggccaacgccctcttgatgagcgcaaagagctggactagcggaaatccggtctggacgctatccatttcccttccagcaggaacctcttttgagtacaagttcattcgaaaggatgatggttcctcggatgttgtctgggaaagtgacccgaatcgttcgtacaacgtgccgaaggattgcggtgccaacacggccaccgtgaattcttggtggcgatga

SEQ ID NO: 594 - protein, 617 aa, Thermomyces lanuginosus ATCC 200065
  SIGNAL (1)...(23)
MLFQPTLCAALGLAALIVQGGEARPETTVPHATGSLDDFLAAQSPIAFQGILNNIGPSGAYSEGVNPGVVIASPSKQDPDYFYTWVRDAALTVQYLVEELVAGNASLQFLIQDYISSQARLQTVENPSGSLSSGGLGEPKFHVDETAFTDSWGRPQRDGPPLRAIAMISFANYLIDNGHQSTVEDIIWPIVRNDLSYVSQHWNETTFDIWEEVHSSSFFTTAVQYRALVQGSALASKLGHTCDNCGSQAPQILCFLQSYWTGSHILANTGGGRSGKDVSTILGVIGSFDPNADCDDVTFQPCSARALANHKQVVDSFRSIYAINAGIPSGSAVAVGRYPEDVYQGGHPWYLTTAAAAEQLYDAIYQWNHVGHIDINAVNLDFFKSIYPSAAEGTYTSDSSTFQDIISAVRTYADGFLSVIEKYTPPDNLLAEQFHRETGIPLSAASLTWSYAALNTAAQRRASIVPSPWNSNSTDLPDKCSATSATGPYATPTNTAWPTTTQPPERPACTPPSEVTLTFNALVDTAFGQNIYLVGSIPELGSWDPANALLMSAKSWTSGNPVWTLSISLPAGTSFEYKFIRKDDGSSDVVWESDPNRSYNVPKDCGANTATVNSWWR

SEQ ID NO: 595 - DNA, 27 bp, Artificial Sequence
  Primer
gcgaccttggattcatggttgagcaac

SEQ ID NO: 596 - DNA, 27 bp, Artificial Sequence
  Primer
cacaatagagacgaagccatcggcgaa

SEQ ID NO: 597 - DNA, 26 bp, Artificial Sequence
  Primer
atgttattccaaccgactttgtgcgc

SEQ ID NO: 598 - DNA, 25 bp, Artificial Sequence
  Primer
tcatcgccaccaagaattcacggtg

SEQ ID NO: 599 - DNA, 32 bp, Artificial Sequence
  Primer
gtctcgagaaaagagcaacgggctcgctcgac

SEQ ID NO: 600 - DNA, 32 bp, Artificial Sequence
  Primer
gttctagatcatcgccaccaagaattcacggt

SEQ ID NO: 601 - DNA, 25 bp, Artificial Sequence
  Primer
gtccatggcaacgggctcgctcgac

SEQ ID NO: 602 - DNA, 32 bp, Artificial Sequence; identical to SEQ ID NO: 600
  Primer

SEQ ID NO: 603 - DNA, 1770 bp, Unknown
  Obtained from an environmental sample
atgcaaaacacagcgaaaaactccatctggcagagggtgcgccacagcgccattgccttatccgctctcagcttatcctttggcctgcaggccagcgagttaccacaaattccaccacagcaggtgaacaacaccatgtaccaggcattttattgggatgcctaccctggcctttgggccaatttaccggccatggcggcccctttggccgagcgtggcattacctcgatgtggttgccgccggcggcaaaaggcatgaatggcaccaacagcgttggctacgatgtctatgacttctgggatctgggcgaattctaccaaaaagggaccatcgccacccgttacggcacccgccagcagctggaccaggcgctgagtgcgctggatcaactgggtgttcaggcctattttgatgtggtctttaaccaccgcatgggcgccgatgcccaggaatacattcctggctatggactggcctggaccgagtatcatctgcaaggtcggcaggcgcattatacccagcaaaactggggctacttgtggcacgactttgactggaactggaccgcgtttaatggctccgacaatcagctctaccccggcaaatggtggggcaataccttccacttcccttatttgatgggtgaggatgtcgattacaaccgctttgaagtgcagcaggaaatgaaagcctggggggagtggatcatcaacagcgttggctttagcggctttcggatggatgccattgcccatgttgataccgattttacccgtgactggatcaatcacgtacagtgggccaccagcgaggatgtgttctttgtcgcagaagcctgggtcagtgatatcaacggctatctggatgcagtcaatacgccgcatttgcgcgcttttgatttcaatttgcgcgaagactttgttgctttaagcagtggtggcaaagacatgcgctggtggggtggtctggttaatagccagcaccgtgatcgggcggtcacttttgtcgataaccacgataccagccgggccggcaacccttatggcatgccgcaggtgatcaactacaagaaccaggcctacgcttacattctgttgcgtgagcatggggtgccgactgtgtttgcccgcgattacgacgaatttggcatgacgccaacgctggataaattgattgaggcgcgccgctactttgcctacggtcctggtcatgagtactccggcaataccgaggccgtttacgcctatgtgcgcgaggggcttagcactgtgccgggcaccggtctggtgatgctgatatcgggtcgaaactggggtggtcagcagtcgttcaccatcaacagccatcagccgaataccaccttttacgattataccggcaatgtcagcggcacggtgaccaccaatgcgcagggttatggcagcttcccggtcactatgacggaaagtaccggttggtcagtctgggtaccacaatccagtggtggcactcagccgggatccattaccctgcggatgaccaaggatgttggctatggtttttcactgttcttcactggcagcagtgcagagctcaccaattggggcggcggtattgaaggcacctggaccagtggccatgtctgggaagtgaccatcccggatccgggcaactttgaatggaaaacccgtaaaggcccaaccggcggcagtggtcaggactgggaaagtggtagcaaccacaatcagaccaatttgcaccccagttttaatggtgggtttagatctcgc

SEQ ID NO: 604 - protein, 590 aa, Unknown
  Obtained from an environmental sample
  SIGNAL (1)...(31)
  DOMAIN (44)...(395): Alpha amylase, catalytic domain
MQNTAKNSIWQRVRHSAIALSALSLSFGLQASELPQIPPQQVNNTMYQAFYWDAYPGLWANLPAMAAPLAERGITSMWLPPAAKGMNGTNSVGYDVYDFWDLGEFYQKGTIATRYGTRQQLDQALSALDQLGVQAYFDVVFNHRMGADAQEYIPGYGLAWTEYHLQGRQAHYTQQNWGYLWHDFDWNWTAFNGSDNQLYPGKWWGNTFHFPYLMGEDVDYNRFEVQQEMKAWGEWIINSVGFSGFRMDAIAHVDTDFTRDWINHVQWATSEDVFFVAEAWVSDINGYLDAVNTPHLRAFDFNLREDFVALSSGGKDMRWWGGLVNSQHRDRAVTFVDNHDTSRAGNPYGMPQVINYKNQAYAYILLREHGVPTVFARDYDEFGMTPTLDKLIEARRYFAYGPGHEYSGNTEAVYAYVREGLSTVPGTGLVMLISGRNWGGQQSFTINSHQPNTTFYDYTGNVSGTVTTNAQGYGSFPVTMTESTGWSVWVPQSSGGTQPGSITLRMTKDVGYGFSLFFTGSSAELTNWGGGIEGTWTSGHVWEVTIPDPGNFEWKTRKGPTGGSGQDWESGSNHNQTNLHPSFNGGFRSR

SEQ ID NO: 605 - DNA, 2160 bp, Unknown
  Obtained from an environmental sample
atggttaaccatttgaaaaaatggatcgccggcatggcgttgacgctcgctctgttgaccgggacggtcgttcccggccttccggtccaggtcgcttccgccgcgcccgacacctccgtatcgaacaagcagaacttcagcacggacgtgatttaccagattttcaccgaccggttcgccgacggcaatcccgccaacaatccgacgggctcggcctacagccccggctgcacgaatttgcggctgtactgcggcggcgactggaaaggcattacggacaagatcaacgccggttatttcaccaatatgggcgtaacggcgctgtggatttcgcagccggtggaaaacatttattccgtcatcaactactccggcgtcaacaatacgtcctaccacgggtactgggctcgcgatttcaaaaagaccaacccttattacggcacgttcgcggatttgcaaaccctgatcaatgccgcgcatgccaaaggcatcaagatcgtgatcgacttcgcgcccaatcacacctcgccggccctggaaacggacagctccttcgccgagaacggccggctgtacgacaacggcacgctgctcggcggctatacgaacgacacgaacggctacttccatcataacgggggaaccgatttctcctcgctggaagacggcatttacagaaacctgtacgacctcgccgacctcaaccacaacgtcagccggatcgacacctacttcaaggaagcgatcaaagtctggctcgacttgggaatcgacggcatccgcgtcgatgcggtcaagcatatgccgatgggctggcagaagaactggatgtcctacatctacggttacaaaccggtgttcaccttcggcgagtggttcctcggcacgaatgagaacgacccgagcaacgtctatttcgccaacgaatccggcatgagcctgctcgacttccgtttcgcccagaaggttcgccaggtgctccgcgacaacaccgacacgatgtacggcctggattcgatgatttcctccaccgcctccgactacgcgcaggtcgccgaccaggtcaccttcatcgacaatcacgacatggagcggttcaaatcgggctcggtcagcaaccgccgggtggagcaggcgctggcgctgctgctgacgtcccgcggcgttcccgccatctattacggaacggagcagtatatgagcggcggcaccgatccggacaaccgtgcgatgatgtcctccttctccgagacgacgaccgcgtttaacgtaatcaaaaaactcgctccgcttcgcaagtcgaatcccgccatcgcatacggttcgacccagcagcggtggatcaacaacgacgtttacatttacgagcggaaattcggaaacagcgtggcggtcgtcgccatcaaccgcaacttgtccagctccgcgtcgatcagcggattggtcacttccttcccggcgggcacctatacggaccaactgggcggcctgctcggcggcggcagcatcacggcaagcagcaccggcgccgtatcgacgtttacgctcggagcgggagccgtagccgtatggcaatatacgccggcccaaacgacgccggtgatcggccatgtcggtccggtcatgggcaaagccggcaacaccgtcacgatcgacggcagaggtttcggctccacgaagggcaccgtctacttcggcacgaccgcggtgaccggttcgggcatcgtttcgtgggaagacacgcagatcaaggtcgtcgtgccttccgtcgccgcaggcaaatacaacgtgaaagtccgcacgtcgggctcggtcgacagcaacagctacaacggctttaatgtgttgacgggcaaccaggtgtccgtgcgcttcatcgtgcaaaacgcgacgaccgtcagcggcgaaaacgtctatctcgtcggcaacgtcgccgaactcggcaactgggatccggcctcggccataggcccgatgttcaaccgggtcatccgaacctatccgacctggtatttcgacgtcagcgtaccggccggcaccgccctggaattcaaatttatcaaaaagaacggctccgtcgtgacctgggaaggcggctccaaccatacgtacacgaccccggccagcggcaccggcaccataacggtcaactggcagtaa

SEQ ID NO: 606 - protein, 719 aa, Unknown
  Obtained from an environmental sample
  SIGNAL (1)...(34)
  DOMAIN (53)...(432): Alpha amylase, catalytic domain
  DOMAIN (620)...(716): Starch binding domain
  DOMAIN (533)...(616): IPT/TIG domain
  DOMAIN (444)...(528): Alpha amylase, C-terminal all-beta domain
MVNHLKKWIAGMALTLALLTGTVVPGLPVQVASAAPDTSVSNKQNFSTDVIYQIFTDRFADGNPANNPTGSAYSPGCTNLRLYCGGDWKGITDKINAGYFTNMGVTALWISQPVENIYSVINYSGVNNTSYHGYWARDFKKTNPYYGTFADLQTLINAAHAKGIKIVIDFAPNHTSPALETDSSFAENGRLYDNGTLLGGYTNDTNGYFHHNGGTDFSSLEDGIYRNLYDLADLNHNVSRIDTYFKEAIKVWLDLGIDGIRVDAVKHMPMGWQKNWMSYIYGYKPVFTFGEWFLGTNENDPSNVYFANESGMSLLDFRFAQKVRQVLRDNTDTMYGLDSMISSTASDYAQVADQVTFIDNHDMERFKSGSVSNRRVEQALALLLTSRGVPAIYYGTEQYMSGGTDPDNRAMMSSFSETTTAFNVIKKLAPLRKSNPAIAYGSTQQRWINNDVYIYERKFGNSVAVVAINRNLSSSASISGLVTSFPAGTYTDQLGGLLGGGSITASSTGAVSTFTLGAGAVAVWQYTPAQTTPVIGHVGPVMGKAGNTVTIDGRGFGSTKGTVYFGTTAVTGSGIVSWEDTQIKVVVPSVAAGKYNVKVRTSGSVDSNSYNGFNVLTGNQVSVRFIVQNATTVSGENVYLVGNVAELGNWDPASAIGPMFNRVIRTYPTWYFDVSVPAGTALEFKFIKKNGSVVTWEGGSNHTYTTPASGTGTITVNWQ

SEQ ID NO: 607 - DNA, 3705 bp, Unknown
  Obtained from an environmental sample
ttggaaacgacgatcattacattcttcttcaatgcgaaaacaaaagaggtgtacaccgactacaaccccaatggctctgacggtgttgttcagaaagaccgattaaaacacaatacatgggatacgctgtaccgccagccgtttggtgcggtgaaagcgggaacgaaggtgacgcttcgtctggcggcgaaaaaaggcgatttgacgaaggcggatgtgtatgtgaaaaatgcgacgaccggaaccgccaaagtctacacgatggaaaaagtcggcgtgctcggggatgatgaatattgggaggctgcgtttaccccttctgcgccgggggtatacggttataaatttatcgctgtcgatgccgggatgaaggcggaatatggtgaagatacgaaagaaggacaatgggggagggcggtcgacaaaaatgcggggctgtttcagctgaccgtctatgatccgaattacaaaacaccagattggatgaaagaagcggttgtgtatcaaattttcccggatcggttctttaatggcaacccttcaaatgataacagcaagcagcaggcacgcggggcgcagccgattgagcatcgcgattggtcggatttgcccgataatccgcgcctgaaagggacgagcggctacgatggcgacggtgaatggtcgaatgactttttcggcggagacatcgccggaattgaacaaaagttggattatttgcagtcgcttggagtgaacacgatttacttaaatccgatcgccaatgcgccatcgaaccataaatatgatgcgagcaattacaaagaattggatccgatgttcggttccccggaagaattccaatcgtttgtgcaggcgcttgcgaaccgggggatgcatctcatcttagacggggtgttcaaccacgtatccgacgattcgatttactttgaccgctaccaccgctatccgaccgtcggtgcgtatgaatattgggaagcggtttacgatttgatgaatgaaaaaggattgagcgaggaagaagcgcggaaacaagtggaagagaagttcaaacaagagggacagacgttcagcccgtatgggtttcacctttggttcaatattgaaaacaaaaaagtcgatggccattatcaataccaatcatggtggggctatgacagtctgccggagtttaagtcggtgacgggggaaaaagtgccgcatccgagtgaattgaacaacgatgcgctcgcgaattacattttccgtgaatcggattcggtggcgaaaagctggattgccctcggcgcctccggctggcggttggatgtggccaatgaggtggatccggcgttttggcgcgagtttcgccaagaattgcttcaagggtcgtacggtcgtggtccgacgttaaaagagggggagcagccgctcattttaggggaaatttgggatgacgcatcgaaatattttctaggcgaccagtacgattccgtgatgaactaccggttccgcggggcggtgcttgactttttgaaaaacggaaatgcagaagaggcggacaagcggctgacggccataagggaagactacccaagtgaagcgttttatgcgctgatgaacttaatcggttcgcatgacacggcgcgggcggtctttctgcttgggaacggaacggattcatccgagcgggcggagcttgatccgaattataatgaggaacttgggaaaaagcggctcaagctggcggtgattttgcagatgggatacccgggagcgccgacgatttattacggcgatgaagcgggagtaacaggctcaagagacccagacaaccgccgcacgtatccgtggggcaaagaagatcaaaatctgttgtcccattatcagaaagtggggcacattcgccagcaccatcaatcgttgttggcccatggcgacatcaagacggtgtatgcgcaaggggatgtatacgtatttgcccgccaatacgggcgtgaagtggcgctcattgccctcaaccgcggcaatgaggacaagacggtggcgcttgacgtcgcttcgttgcttccgaacggcaccgtgcttacggatgagttgcatgatggcggggaagctacggtcgctggcggaacgttgacggtcacgattccggccctggatggacggatgatgtttgggacggtgacggcggaaatgccggcagcagtcagcaatttgcaggcgagcgcttcggatggctgcgtgacgttaacgtgggaaggaaatgcgtcgagataccgaatttacgagtccacgttaaaaggtgccggttatacgatggtgcaagagacggaaacaacttcggccacgatcggttcgttgacgaacggaacagcctattactttgccgttgcggcggtcgatgaaaacgggaatgaatcaccgaaggtcgaaacgaatcgcgtcgttcctcattacccgctgacgagcgacaatgtccagttcgtgacaacgttaagcgatgccacactggatttgtcaaagccgcagcaagtggatgtccatgtcaacatcgacaatgtgacaagcaaaggagcagctgatgggttgcaagcggtgttgcaagtgaaaggcccgcatgacgaaacatggaaagaatacagagcggcttaccaaggacaagacggcgacgccaacgtgttccgagctgccttcactccgctcgccgcagggacgtatacgtatcgttatgcgctgacgaccaacctcggcgaggagtgggtgtatacagaagagaagcaagtgacgtttgcggcagacaacagcgaccaaatagcgccagcagacgccatcgagctgcggcagcctgcggttgaatccggacaagtgaatttatcatggacgtttgttgggaaaaaagatggggatgcttatttgttagccatcgagcgcaacggtgatatcgtgcatacaaccacttcgatcggcgattcatttacagactacgatgtcgaaaacggcaccgagtacacgtatgttgtcaagttgtatgaccgcgccggcaatgttgtggcgtcaaacacggtcaaggtgacgccggacattgtgatggtgaaagtgatttttaaagtgagggcgccggattacacaccgttggatgcccgaattacgattccgaacagcttgaacggctggaacacaggggcctgggagatgtcgcgcaacggtgcggtgacgcccgattggcaatttaccgtcgaggtgcaggaaggggaaacgatcacctataagtatgtgaaaggcggatcgtgggatcaagaggggttggccgaccatacgcgtgaggacgacaacgatgatgacgtgagctactacggctatgggacgattggcaccgacttgaaagtgacggtccacaatgaaggaaacaatacgatgattgtgcaagaccgcattttgcgctggatcgatatgccggtcgtcatcgaagaggtgcaaaaacaaggaagtcaagtgacgatcaagggcaatgccattaaaaacggtgttttgacgatcaatggcgagcgggtgccgattgatggccggatggcattctcgtacacgtttgcgccggccagccatcaaaaagaagtgttgatccatatcgaaccatcggccgaaagcaaaacagccattttcaacaacgacggcggagcgattgcgaaaaacacaaaagattacgtgctgaatttagaaacgaag

SEQ ID NO: 608 - protein, 1235 aa, Unknown
  Obtained from an environmental sample
  DOMAIN (169)...(629): Alpha amylase, catalytic domain
  DOMAIN (727)...(801): Fibronectin type III domain
  DOMAIN (646)...(724): Alpha amylase, C-terminal all-beta domain
METTIITFFFNAKTKEVYTDYNPNGSDGVVQKDRLKHNTWDTLYRQPFGAVKAGTKVTLRLAAKKGDLTKADVYVKNATTGTAKVYTMEKVGVLGDDEYWEAAFTPSAPGVYGYKFIAVDAGMKAEYGEDTKEGQWGRAVDKNAGLFQLTVYDPNYKTPDWMKEAVVYQIFPDRFFNGNPSNDNSKQQARGAQPIEHRDWSDLPDNPRLKGTSGYDGDGEWSNDFFGGDIAGIEQKLDYLQSLGVNTIYLNPIANAPSNHKYDASNYKELDPMFGSPEEFQSFVQALANRGMHLILDGVFNHVSDDSIYFDRYHRYPTVGAYEYWEAVYDLMNEKGLSEEEARKQVEEKFKQEGQTFSPYGFHLWFNIENKKVDGHYQYQSWWGYDSLPEFKSVTGEKVPHPSELNNDALANYIFRESDSVAKSWIALGASGWRLDVANEVDPAFWREFRQELLQGSYGRGPTLKEGEQPLILGEIWDDASKYFLGDQYDSVMNYRFRGAVLDFLKNGNAEEADKRLTAIREDYPSEAFYALMNLIGSHDTARAVFLLGNGTDSSERAELDPNYNEELGKKRLKLAVILQMGYPGAPTIYYGDEAGVTGSRDPDNRRTYPWGKEDQNLLSHYQKVGHIRQHHQSLLAHGDIKTVYAQGDVYVFARQYGREVALIALNRGNEDKTVALDVASLLPNGTVLTDELHDGGEATVAGGTLTVTIPALDGRMMFGTVTAEMPAAVSNLQASASDGCVTLTWEGNASRYRIYESTLKGAGYTMVQETETTSATIGSLTNGTAYYFAVAAVDENGNESPKVETNRVVPHYPLTSDNVQFVTTLSDATLDLSKPQQVDVHVNIDNVTSKGAADGLQAVLQVKGPHDETWKEYRAAYQGQDGDANVFRAAFTPLAAGTYTYRYALTTNLGEEWVYTEEKQVTFAADNSDQIAPADAIELRQPAVESGQVNLSWTFVGKKDGDAYLLAIERNGDIVHTTTSIGDSFTDYDVENGTEYTYVVKLYDRAGNVVASNTVKVTPDIVMVKVIFKVRAPDYTPLDARITIPNSLNGWNTGAWEMSRNGAVTPDWQFTVEVQEGETITYKYVKGGSWDQEGLADHTREDDNDDDVSYYGYGTIGTDLKVTVHNEGNNTMIVQDRILRWIDMPVVIEEVQKQGSQVTIKGNAIKNGVLTINGERVPIDGRMAFSYTFAPASHQKEVLIHIEPSAESKTAIFNNDGGAIAKNTKDYVLNLETK

SEQ ID NO: 609 - DNA, 1764 bp, Unknown
  Obtained from an environmental sample
atgcaaaacacagcgaaaaactccatctggcagagggtgcgccacagcgccattgccttatccgctctcagcttatcctttggcctgcaggccagcgagttaccacaaattccaccacagcaggtgaacaacaccatgtaccaggcattttattgggatgcctaccctggcctttgggccaatttaccggccatggcggcccctttggccgagcgtggcattacctcgatgtggttgccgcccgccgccaaaggcatgaatggtactttcagtgtcggttacgatgtatacgatttctgggatctgggcgagtttaaccaaaaaggcaccaccgccacccgttacggtactcgtcagcagctgcaacaagcactgagtgctctggaccaactgggtattcaggcctattttgatgtggtgtttaaccaccgcatgggcgccgatgcacaggagaatattcctggctttggcctggcctggaccgagtatcatctgcaaggtcgtcaggcgcattatacccagcaaaactggggctacttgtggcacgactttgactggaactggaccgcgtttaatggctccgacaatcagctctaccccggcaaatggtggggcaataccttccacttcccttatttgatgggtgaggatgtcgattacaaccgctttgaagtgcagcaggaaatgaaagcctggggggagtggatcatcaacagcgttggctttagcggctttcggatggatgccattgcccatgttgataccgattttacccgtgactggatcaatcacgtacagtgggccaccagcgaggatgtgttctttgtcgcagaagcctgggtcagtgatataaacggctatctggatgcagtcaatacgccgcatttgcgcgcttttgatttcaatttgcgcgaagactttgttgctttaagcagtggtggcaaagacatgcgctggtggggtggtctggttaatagccagcaccgtgatcgggcggtcacttttgtcgataaccacgataccagccgggccggcaacccttatggcatgccgcaggtgatcaactacaagaaccaggcctacgcttacattctgttgcgtgagcatggggtgccgactgtgtttgcccgcgattacgacgaatttggcatggcgccaacgctggataaattgattgaagcacggcgttactttgcctatggtcctggccatgagtactccggcaataccgaggccgtctacgcctgtgtgcgcgaagggcttagcactgtgccgggcaccggtctggtgatgctgatatcgggtcgaaactggggtggtcagcagtcgttcaccatcaacagccatcagccgaataccaccttttacgattataccggcaatgtcagtggcactgtgaccaccaatgcgcagggttatggcagcttcccggtcactatgacggaaagtaccggttggtcagtctgggtaccacaatccagtggtggcactcagccgggatccattaccctgcggataaccaaggatgttggctatggtttttcactgttcttcactggcagcagtgcagagctcactaattggggcggcggtattgaaggcacctggaccagtggccatgtctgggaagtgaccatcccggatcccggcaactttgaatggaaaacccgtaaaggcccaaccggtggcagtggtcaggactgggaaagtgacagcaaccacaaccagaccaatttgcaccccagttttaatggtgggttttaa

SEQ ID NO: 610 - protein, 587 aa, Unknown
  Obtained from an environmental sample
  SIGNAL (1)...(31)
  DOMAIN (44)...(395): Alpha amylase, catalytic domain
MQNTAKNSIWQRVRHSAIALSALSLSFGLQASELPQIPPQQVNNTMYQAFYWDAYPGLWANLPAMAAPLAERGITSMWLPPAAKGMNGTFSVGYDVYDFWDLGEFNQKGTTATRYGTRQQLQQALSALDQLGIQAYFDVVFNHRMGADAQENIPGFGLAWTEYHLQGRQAHYTQQNWGYLWHDFDWNWTAFNGSDNQLYPGKWWGNTFHFPYLMGEDVDYNRFEVQQEMKAWGEWIINSVGFSGFRMDAIAHVDTDFTRDWINHVQWATSEDVFFVAEAWVSDINGYLDAVNTPHLRAFDFNLREDFVALSSGGKDMRWWGGLVNSQHRDRAVTFVDNHDTSRAGNPYGMPQVINYKNQAYAYILLREHGVPTVFARDYDEFGMAPTLDKLIEARRYFAYGPGHEYSGNTEAVYACVREGLSTVPGTGLVMLISGRNWGGQQSFTINSHQPNTTFYDYTGNVSGTVTTNAQGYGSFPVTMTESTGWSVWVPQSSGGTQPGSITLRITKDVGYGFSLFFTGSSAELTNWGGGIEGTWTSGHVWEVTIPDPGNFEWKTRKGPTGGSGQDWESDSNHNQTNLHPSFNGGF

SEQ ID NO: 611 - DNA, 3804 bp, Unknown
  Obtained from an environmental sample
ttggaaacgacgatcattacattcttcttcaatgcgaaaacaaaagaggtgtacaccgactacaaccccaatggctctgacggtgttgttcagaaagaccgattaaaacacaatacatgggatacgctgtaccgccagccgtttggtgcggtgaaagcgggaacgaaggtgacgcttcgtctggcggcgaaaaaaggcgatttgacgaaggcggatgtgtatgtgaaaaatgcgacgaccggaaccgccaaagtctacacgatggaaaaagtcggcgtgctcggggatgatgaatattgggaggctgcgtttaccccttctgcgccgggggtatacggttataaatttatcgctgtcgatgccgggatgaaggcggaatatggtgaagatacgaaagaaggacaatgggggagggcggtcgacaaaaatgcggggctgtttcagctgaccgtctatgatccgaattacaaaacaccagattggatgaaagaagcggttgtgtatcaaattttcccggatcggttctttaatggcaacccttcaaatgataacagcaagcagcaggcacgcggggcgcagccgattgagcatcgcgattggtcggatttgcccgataatccgcgcctgaaagggacgagcggctacgatggcgacggtgaatggtcgaatgactttttcggcggagacatcgccggaattgaacaaaagttggattatttgcagtcgcttggagtgaacacgatttacttaaatccgatcgccaatgcgccatcgaaccataaatatgatgcgagcaattacaaagaattggatccgatgttcggttccccggaagaattccaatcgtttgtgcaggcgcttgcgaaccgggggatgcatctcatcttagacggggtgttcaaccacgtatccgacgattcgatttactttgaccgctaccaccgctatccgaccgtcggtgcgtatgaatattgggaagcggtttacgatttgatgaatgaaaaaggattgagcgaggaagaagcgcggaaacaagtggaagagaagttcaaacaagagggacagacgttcagcccgtatgggtttcacctttggttcaatattgaaaacaaaaaagtcgatggccattatcaataccaatcatggtggggctatgacagtctgccggagtttaagtcggtgacgggggaaaaagtgccgcatccgagtgaattgaacaacgatgcgctcgcgaattacattttccgtgaatcggattcggtggcgaaaagctggattgccctcggcgcctccggctggcggttggatgtggccaatgaggtggatccggcgttttggcgcgagtttcgccaagaattgcttcaagggtcgtacggtcgtggtccgacgttaaaagagggggagcagccgctcattttaggggaaatttgggatgacgcatcgaaatattttctaggcgaccagtacgattccgtgatgaactaccggttccgcggggcggtgcttgactttttgaaaaacggaaatgcagaagaggcggacaagcggctgacggccataagggaagactacccaagtgaagcgttttatgcgctgatgaacttaatcggttcgcatgacacggcgcgggcggtctttctgcttgggaacggaacggattcatccgagcgggcggagcttgatccgaattataatgaggaacttgggaaaaagcggctcaagctggcggtgattttgcagatgggatacccgggagcgccgacgatttattacggcgatgaagcgggagtaacaggctcaagagacccagacaaccgccgcacgtatccgtggggcaaagaagatcaaaatctgttgtcccattatcagaaagtggggcacattcgccagcaccatcaatcgttgttggcccatggcgacatcaagacggtgtatgcgcaaggggatgtatacgtatttgcccgccaatacgggcgtgaagtggcgctcattgccctcaaccgcggcaatgaggacaagacggtggcgcttgacgtcgcttcgttgcttccgaacggcaccgtgcttacggatgagttgcatgatggcggggaagctacggtcgctggcggaacgttgacggtcatgattccggccctggatggacggatgatgtttgggacggtgacggcggaaatgccggcagcagtcagcaatttgcaggcgagcgcttcggatggctgcgtgacgttaacgtgggaaggaaatgcgtcgagataccgaatttacgagtccacgttaaaaggtgccggttatacgatggtgcaagagacggaaacaacttcggccacgatcggttcgttgacgaacggaacagcctattactttgccgttgcggcggtcgatgaaaacgggaatgaatcaccgaaggtcgaaacgaatcgcgtcgttcctcattacccgctgacgagcgacaatgtccagttcgtgacaacgttaagcgatgccacactggatttgtcaaagccgcagcaagtggatgtccatgtcaacatcgacaatgtgacaagcaaaggagcagctgatgggttgcaagcggtgttgcaagtgaaaggcccgcatgacgaaacatggaaagaatacagagcggcttaccaaggacaagacggcgacgccaacgtgttccgagctgccttcactccgctcgccgcagggacgtatacgtatcgttatgcgctgacgaccaacctcggcgaggagtgggtgtatacagaagagaagcaagtgacgtttgcggcagacaacagcgaccaaatagcgccagcagacgccatcgagctgcggcagcctgcggttgaatccggacaagtgaatttatcatggacgtttgttgggaaaaaagatggggatgcttatttgttagccatcgagcgcaacggtgatatcgtgcatacaaccacttcgatcggcgattcatttacagactacgatgtcgaaaacggcaccgagtacacgtatgttgtcaagttgtatgaccgcgccggcaatgttgtggcgtcaaacacggtcaaggtgacgccggacattgtgatggtgaaagtgatttttaaagtgagggcgccggattacacaccgttggatgcccgaattacgattccgaacagcttgaacggctggaacacaggggcctgggagatgtcgcgcaacggtgcggtgacgcccgattggcaatttaccgtcgaggtgcaggaaggggaaacgatcacctataagtatgtgaaaggcggatcgtgggatcaagaggggttggccgaccatacgcgtgaggacgacaacgatgatgacgtgagctactacggctatgggacgattggcaccgacttgaaagtgacggtccacaatgaaggaaacaatacgatgattgtgcaagaccgcattttgcgctggatcgatatgccggtcgtcatcgaagaggtgcaaaaacaaggaagtcaagtgacgatcaagggcaatgccattaaaaacggtgttttgacgatcaatggcgagcgggtgccgattgatggccggatggcattctcgtacacgtttgcgccggccagccatcaaaaagaagtgttgatccatatcgaaccatcggccgaaagcaaaacagccattttcaacaacgacggcggagcgattgcgaaaaacacaaaagattacgtgctgaatttagaaacgaagcaattcaaaaagcttctcgagagtacttctagagcggccgcgggcccatcgattttccacccgggtggggtaccaggtaagtgtacccaattcgcccta

SEQ ID NO: 612 - protein, 1268 aa, Unknown
  Obtained from an environmental sample
  DOMAIN (646)...(724): Alpha amylase, C-terminal all-beta domain
  DOMAIN (727)...(801): Fibronectin type III domain
  DOMAIN (169)...(629): Alpha amylase, catalytic domain
METTIITFFFNAKTKEVYTDYNPNGSDGVVQKDRLKHNTWDTLYRQPFGAVKAGTKVTLRLAAKKGDLTKADVYVKNATTGTAKVYTMEKVGVLGDDEYWEAAFTPSAPGVYGYKFIAVDAGMKAEYGEDTKEGQWGRAVDKNAGLFQLTVYDPNYKTPDWMKEAVVYQIFPDRFFNGNPSNDNSKQQARGAQPIEHRDWSDLPDNPRLKGTSGYDGDGEWSNDFFGGDIAGIEQKLDYLQSLGVNTIYLNPIANAPSNHKYDASNYKELDPMFGSPEEFQSFVQALANRGMHLILDGVFNHVSDDSIYFDRYHRYPTVGAYEYWEAVYDLMNEKGLSEEEARKQVEEKFKQEGQTFSPYGFHLWFNIENKKVDGHYQYQSWWGYDSLPEFKSVTGEKVPHPSELNNDALANYIFRESDSVAKSWIALGASGWRLDVANEVDPAFWREFRQELLQGSYGRGPTLKEGEQPLILGEIWDDASKYFLGDQYDSVMNYRFRGAVLDFLKNGNAEEADKRLTAIREDYPSEAFYALMNLIGSHDTARAVFLLGNGTDSSERAELDPNYNEELGKKRLKLAVILQMGYPGAPTIYYGDEAGVTGSRDPDNRRTYPWGKEDQNLLSHYQKVGHIRQHHQSLLAHGDIKTVYAQGDVYVFARQYGREVALIALNRGNEDKTVALDVASLLPNGTVLTDELHDGGEATVAGGTLTVMIPALDGRMMFGTVTAEMPAAVSNLQASASDGCVTLTWEGNASRYRIYESTLKGAGYTMVQETETTSATIGSLTNGTAYYFAVAAVDENGNESPKVETNRVVPHYPLTSDNVQFVTTLSDATLDLSKPQQVDVHVNIDNVTSKGAADGLQAVLQVKGPHDETWKEYRAAYQGQDGDANVFRAAFTPLAAGTYTYRYALTTNLGEEWVYTEEKQVTFAADNSDQIAPADAIELRQPAVESGQVNLSWTFVGKKDGDAYLLAIERNGDIVHTTTSIGDSFTDYDVENGTEYTYVVKLYDRAGNVVASNTVKVTPDIVMVKVIFKVRAPDYTPLDARITIPNSLNGWNTGAWEMSRNGAVTPDWQFTVEVQEGETITYKYVKGGSWDQEGLADHTREDDNDDDVSYYGYGTIGTDLKVTVHNEGNNTMIVQDRILRWIDMPVVIEEVQKQGSQVTIKGNAIKNGVLTINGERVPIDGRMAFSYTFAPASHQKEVLIHIEPSAESKTAIFNNDGGAIAKNTKDYVLNLETKQFKKLLESTSRAAAGPSIFHPGGVPGKCTQFAL

SEQ ID NO: 613 - DNA, 1764 bp, Unknown
  Obtained from an environmental sample
atgcaaaacacagcgaaaaactccatctggcagagggtgcgccacagcgccattgccttatccgctctcagcttatcctttggcctgcaggccagcgagttaccacaaattccaccacagcaggtgaacaacaccatgtaccaggcattttattgggatgcctaccctggcctttgggccaatttaccggccatggcggcccctttggccgagcgtggcattacctcgatgtggttgccgcccgccgccaaaggcatgaatggtactttcagtgtcggttacgatgtatacgatttctgggatctgggcgagtttaaccaaaaaggcaccaccgccacccgttacggtactcgtcagcagctgcaacaagcactgagtgctctggaccaactgggtattcaggcctattttgatgtggtgtttaaccaccgcatgggcgccgatgcacaggagaatattcctggctttggcctggcctggaccgagtatcatctgcaaggtcgtcaggcgcattatacccagcaaaactggggctacttgtggcacgactttgactggaactggaccgcgtttaatggctccgacaatcagctctaccccggcaaatggtggggcaataccttccacttcccttatttgatgggtgaggatgtcgattacaaccgctttgaagtgcagcaggaaatgaaagcctggggggagtggatcatcaacagcgttggctttagcggctttcggatggatgccattgcccatgttgataccgattttacccgtgactggatcaatcacgtacagtgggccaccagcgaggatgtgttctttgtcgcagaagcctgggtcagtgatataaacggctatctggatgcagtcaatacgccgcatttgcgcgcttttgatttcaatttgcgcgaagactttgttgctttaagcagtggtggcaaagacatgcgctggtggggtggtctggttaatagccagcaccgtgatcgggcggtcacttttgtcgataaccacgataccagccgggccggcaacccttatggcatgccgcaggtgatcaactacaagaaccaggcctacgcttacattctgttgcgtgagcatggggtgccgactgtgtttgcccgcgattacgacgaatttggcatggcgccaacgctggataaattgattgaagcacggcgttactttgcctatggtcctggccatgagtactccggcaataccgaggccgtctacgcctatgtgcgcgaagggcttagcactgtgccgggcaccggtctggtgatgctgatatcgggtcgaaactggggtggtcagcagtcgttcaccatcaacagccatcagccgaataccaccttttacgattataccggcaatgtcagtggcactgtgaccaccaatgcgcagggttatggcagcttcccggtcactatgacggaaagtaccggttggtcagtctgggtaccacaatccagtggtggcactcagccgggatccattaccctgcggataaccaaggatgttggctatggtttttcactgttcttcactggcagcagtgcagagctcactaattggggcggcggtattgaaggcacctggaccagtggccatgtctgggaagtgaccatcccggatccgggcaactttgaatggaaaacccgtaaaggcccaaccggtggcagtggtcaggactgggaaagtggcagcaaccacaaccagaccaatttgcaccccagttttaatggtgggttttaa

SEQ ID NO: 614 - protein, 587 aa, Unknown
  Obtained from an environmental sample
  SIGNAL (1)...(31)
  DOMAIN (44)...(395): Alpha amylase, catalytic domain
MQNTAKNSIWQRVRHSAIALSALSLSFGLQASELPQIPPQQVNNTMYQAFYWDAYPGLWANLPAMAAPLAERGITSMWLPPAAKGMNGTFSVGYDVYDFWDLGEFNQKGTTATRYGTRQQLQQALSALDQLGIQAYFDVVFNHRMGADAQENIPGFGLAWTEYHLQGRQAHYTQQNWGYLWHDFDWNWTAFNGSDNQLYPGKWWGNTFHFPYLMGEDVDYNRFEVQQEMKAWGEWIINSVGFSGFRMDAIAHVDTDFTRDWINHVQWATSEDVFFVAEAWVSDINGYLDAVNTPHLRAFDFNLREDFVALSSGGKDMRWWGGLVNSQHRDRAVTFVDNHDTSRAGNPYGMPQVINYKNQAYAYILLREHGVPTVFARDYDEFGMAPTLDKLIEARRYFAYGPGHEYSGNTEAVYAYVREGLSTVPGTGLVMLISGRNWGGQQSFTINSHQPNTTFYDYTGNVSGTVTTNAQGYGSFPVTMTESTGWSVWVPQSSGGTQPGSITLRITKDVGYGFSLFFTGSSAELTNWGGGIEGTWTSGHVWEVTIPDPGNFEWKTRKGPTGGSGQDWESGSNHNQTNLHPSFNGGF

SEQ ID NO: 615 - DNA, 1752 bp, Unknown
  Obtained from an environmental sample
atgtccgaaagaggcgtcaggagagccgtgcgcaccgccctggtcgggttggcggcggccgccaccgccgcggtgacgctcggcgctcccaccgcccaggccgcgccggccgggaacaaggacgtcaccgccgtcctgttctcctggaacttcaactccatcgcccgcgagtgcaccgagcgactcggccccgcgggctacggcttcgtgcaggtctcgccgccccaggagcacatccagggctccgcgtggtggacccagtaccagcccgtgagttacaacatctccggccggctcggcaacgagcagcagttccgctcgatggtcaacacctgtaacaacgcgggtgtcggcgtcatcgtggacgcggtcatcaaccacatgtccgccggctcgggcaccggcaccggcggcacctcctacagcaagtacaactaccccggcctctacagcggcaacgacttcggttcctgccgcgaggacatccggggcagcgactacaccaacgaccgctggcgggtccagaactgcgagctggtcggcctcgccgacctggacaccggcagcgcctacgtccagcagcagatcgccggctacatgaaccgtctgctgggctggggcgtcgccggcttccgggtggacgccgtcaagcacatcccggcccggcacatggagcagatccgcgcccgggtcaacggcggcgacgtcttctggaaccaggaggtcatctacggcgccggcgaggcgatcacgcccgaggagtacctcaacaccggtcacgtgcaggagttccgctacgcgttcgacctcaagcggatgttccagggcgaccggatcgccaatctgcagaacttcggcgagtcatggggctacatgccctccaaccgctccggcgtcttcgtcgacaaccacgacaccgagcgcaacggctccaccctcagctacaaggacaacgccgcctacaccctggccaacgtcttcatgctggcctggccctacggcagcccggacgtgcactccggctacgagttcaccaacttcgacgccggtccgcccaacaacggcaacgtgaccgcctgccaccagagcgggtggaagtgccagcacgcctggcaggagatctcctccatggtgggcttccgcaacgccacccgcggccaggccgtcaccaactggtggtccaacggcaacaacgccatcgccttcggccggggcaaccgcggctacgtggcgatcaaccacgagaacaccacactgaaccggaccttccagacctccctgccggccggtgactactgcaacgtgcagaacggcaccaccgtcaccgtcaacggcgccgggcagttcaccgcgagcctaggcgcccgcaccgccctcgccctgcacgtcgacgcccgcaattgcgccggcggcggcaccgggggcaacggcggcaccgggggaggcgagaacccggtgaccggcggtgcctccttcggcgtcgacgcgaccacgcagatgggccagaacatccacgtcgcgggcaacatccccgcgctgggcgactggaacaccgccaacgccccccgcatgagcgccgacacctacccggtctggcggctggaactgaacctgccgcccggcaccaccttccagtacaagtacatccgcagggacgccaacggcaacgtgacctgggaatccgggaacaaccgcaccgccaccgtgccctcctccggccgggtgacgctcaacgacacctggcgcaactga

SEQ ID NO: 616 - protein, 583 aa, Unknown
  Obtained from an environmental sample
  SIGNAL (1)...(34)
  DOMAIN (390)...(466): Alpha amylase, C-terminal all-beta domain
  DOMAIN (487)...(579): Starch binding domain
  DOMAIN (41)...(381): Alpha amylase, catalytic domain
MSERGVRRAVRTALVGLAAAATAAVTLGAPTAQAAPAGNKDVTAVLFSWNFNSIARECTERLGPAGYGFVQVSPPQEHIQGSAWWTQYQPVSYNISGRLGNEQQFRSMVNTCNNAGVGVIVDAVINHMSAGSGTGTGGTSYSKYNYPGLYSGNDFGSCREDIRGSDYTNDRWRVQNCELVGLADLDTGSAYVQQQIAGYMNRLLGWGVAGFRVDAVKHIPARHMEQIRARVNGGDVFWNQEVIYGAGEAITPEEYLNTGHVQEFRYAFDLKRMFQGDRIANLQNFGESWGYMPSNRSGVFVDNHDTERNGSTLSYKDNAAYTLANVFMLAWPYGSPDVHSGYEFTNFDAGPPNNGNVTACHQSGWKCQHAWQEISSMVGFRNATRGQAVTNWWSNGNNAIAFGRGNRGYVAINHENTTLNRTFQTSLPAGDYCNVQNGTTVTVNGAGQFTASLGARTALALHVDARNCAGGGTGGNGGTGGGENPVTGGASFGVDATTQMGQNIHVAGNIPALGDWNTANAPRMSADTYPVWRLELNLPPGTTFQYKYIRRDANGNVTWESGNNRTATVPSSGRVTLNDTWRN

SEQ ID NO: 617 - DNA, 1668 bp, Unknown
  Obtained from an environmental sample
atgaaccgatacctgcgactggccgcgttgacgctggccctggcgccgctggcctacccctggggtaatctggcccgcgccgccgatgcaccgggcaagaccgccagcggcgtgcgctaccacggcggcgacgaaatcatcctccagggctttcactggaacaccgtgcgtacctcgagcaactggtacgcgacgctggccagcatggcgccgaccctggccgccgatggtttcagcgcaatctggatgccggtgccctggcgcgacttctccagctggagcgaccccggcaacggcacctcgggcggcggcgaaggctacttctggcacgacttcaacaagaacggccgctatggcagcgacagcctgctcaaacaggccgccggcgcgctcaatgcggccggggtcaaacccatctacgacgtggtgcccaaccacatgaaccgcggctacccggacaaggaaatcaacctgccggccggccaggggctatggcgccacgactgcaatgacccgggcaactacgccaacgactgcgacgacggcgaccgcttcatgggcggcgacgccgacctcaataccggccacccgcagaactacgcgatgttccgcgacgagttcgccaggctgcgcagccagtatggcgccgggggctttcgcttcgacttcgtccgcggctatgccggcgagcgggtcgccaactggatgagcgatgcccacgacaacggcttctgcctcggcgagctgtggaaggcgccgggcgaatacccaagctgggactggcgcaacggcgccagctggcagcagatcctcaaggactggtccgatcgcgccaagtgcacggtgttcgacttcgccctcaaggagcgcatgcagaacggcggcatcgccgactggcgccacggcctcaacggcaaccccgatgcgcgctggcgcgaggtggcggtgaccttcgtcgacaaccacgacaccggctattcgcccggcccgcacggcggtcagcatcactggccgctgccggacgcacggctgaagcaagcctatgcctacatcctcagcagcccgggcacgccggtggtgtactggccgcacatgtacgactggggccatggcgacttcatccgccagttgatccagatccgccgtgcggcgggggtcaaggcggcctcggcgatccagttccactcgggtttctccggactggtggcgacagtcagcggcagccagcagcaactgctgatcgccctggactccaacctgtccacgcccagccaggtggccagcggcgacttcacccaggcgctcaacactgacaacggcgcgatccgtatctggcgcagcggtcagagtgacgatgaggagcagggcgatctggtcagcgtcaacttccgctgtgacaacggcgtgacccagtggggcgacagcgtctacgcggtgggcaacgtcgcccaactgggcaactggagcccggccagcgccgtgcgcctgaccgataccagcgcctacccgacctggaaaggcagcatcgccctgccggccggccagcaggtgcagtggaaatgcatcgtgcgcagcgaaagcaacccgacccaggtcaagacctggcagccgggcggcaacaacgccgtgacggtgacggcaggggccagcaccgcggggagtttctaa

SEQ ID NO: 618 - protein, 555 aa, Unknown
  Obtained from an environmental sample
  SIGNAL (1)...(27)
  DOMAIN (458)...(554): Starch binding domain
  DOMAIN (45)...(395): Alpha amylase, catalytic domain
MNRYLRLAALTLALAPLAYPWGNLARAADAPGKTASGVRYHGGDEIILQGFHWNTVRTSSNWYATLASMAPTLAADGFSAIWMPVPWRDFSSWSDPGNGTSGGGEGYFWHDFNKNGRYGSDSLLKQAAGALNAAGVKPIYDVVPNHMNRGYPDKEINLPAGQGLWRHDCNDPGNYANDCDDGDRFMGGDADLNTGHPQNYAMFRDEFARLRSQYGAGGFRFDFVRGYAGERVANWMSDAHDNGFCLGELWKAPGEYPSWDWRNGASWQQILKDWSDRAKCTVFDFALKERMQNGGIADWRHGLNGNPDARWREVAVTFVDNHDTGYSPGPHGGQHHWPLPDARLKQAYAYILSSPGTPVVYWPHMYDWGHGDFIRQLIQIRRAAGVKAASAIQFHSGFSGLVATVSGSQQQLLIALDSNLSTPSQVASGDFTQALNTDNGAIRIWRSGQSDDEEQGDLVSVNFRCDNGVTQWGDSVYAVGNVAQLGNWSPASAVRLTDTSAYPTWKGSIALPAGQQVQWKCIVRSESNPTQVKTWQPGGNNAVTVTAGASTAGSF

SEQ ID NO: 619 - DNA, 1716 bp, Bacteria
atggcaaggaagtccgtggccgccgcactcgccctcgtggcgggagccgccgccgtggccgtcacgggaaacacggcggcgcaggccacaccgcccggggagaaggacgtcaccgcggtgatgttcgaatggaacttcgcctccgtcgcccgcgagtgcaccgaccgcctcggccccgccggatacggatacgtccaggtctccccgccccaggaacacctccagggcggccagtggtggacctcctaccagccggtcagctacaagatcgccggacgcctcggtgaccgcaccgccttcaagaagatgatcgacacctgccacgcggccggcgtcaaggtcgtcgccgactccgtcatcaaccacatggcgaacggctccggcacgggaacgggcgggaccccgttctccaagtacgactacccgggcctctactccggcgccgacatggacgactgccgcgcgacgatctccacctaccaggaccggggcaacgtccagaactgcgaactggtccagctccccgacctcgacaccggcgaggaccacgtccgcgggaagatagccggctacctcaacgacctgctctccctcggcgtcgacggcttccgcgtcgacgccgccaagcacatgccggccgccgacctcgccgccatcaaggcgcggctcagcaaccccggcgcgtactggaagcaggaggccatcttcggcgcgggcgaggccgtctccccgagcgagtacctcggcaacggcgacgtccaggagttccgctacgcccgcgacctcaagcgcgtcctgcagaacgagaagctcgcctacctcaagaacttcggcgaggcctgggggtacatgccctccgcccagtccggcgtcttcgtcgacaaccacgacaccgagcgcggcggcgacaccctcagctacaaggacggcgcgaactacaccctcgcctccgtcttcatgctcgcctggccctacggctccccggacgtccactccggctacgagtggaccgacaaggacgccggcccgccgagcggcggacaggtcaacgcctgctacaccgacggctggaagtgccagcacgcctggcgcgagatctcctccatggtcgccttccgcaacaccgcgcgcggccaggccgtcaccggctggtgggacaacggcaacaacgcgatcgctttcggccgcggctccaaggcgtacgtggccatcaaccacgagacctcggcgctcacccgcacctaccagacctcgctgcccgccggcacctactgcgacgtccagtcgaacacccccgtgacggtgaacggctccggccagttcaccgccaccctcggcgcccacaccgccctcgccctgcacgtcggcgcgatgaactgcggctccggcacgaccacgccaccgccgacgaccccgcccgccaccccgggcgcgtccttcaacgccaccgccaccaccgtggtcggtcaggacatctacgtcaccggcaaccgcgccgagctcggcaactggtccccggccgccgccctcaagctcgaccccgcgacgtaccccgtctggaagctgaccgtcggcctgcccgccggaaccgccttcgagtacaagtacctccgcaaggacgccgccggaaacgtcacctgggagtccggcgccaaccgcaccgcgaccgtccccgcctccgggcgcatcgtcctgaacgacaccttccgcagctga

SEQ ID NO: 620 - protein, 571 aa, Bacteria
  SIGNAL (1)...(29)
  DOMAIN (475)...(567): Starch binding domain
  DOMAIN (382)...(458): Alpha amylase, C-terminal all-beta domain
  DOMAIN (36)...(373): Alpha amylase, catalytic domain
MARKSVAAALALVAGAAAVAVTGNTAAQATPPGEKDVTAVMFEWNFASVARECTDRLGPAGYGYVQVSPPQEHLQGGQWWTSYQPVSYKIAGRLGDRTAFKKMIDTCHAAGVKVVADSVINHMANGSGTGTGGTPFSKYDYPGLYSGADMDDCRATISTYQDRGNVQNCELVQLPDLDTGEDHVRGKIAGYLNDLLSLGVDGFRVDAAKHMPAADLAAIKARLSNPGAYWKQEAIFGAGEAVSPSEYLGNGDVQEFRYARDLKRVLQNEKLAYLKNFGEAWGYMPSAQSGVFVDNHDTERGGDTLSYKDGANYTLASVFMLAWPYGSPDVHSGYEWTDKDAGPPSGGQVNACYTDGWKCQHAWREISSMVAFRNTARGQAVTGWWDNGNNAIAFGRGSKAYVAINHETSALTRTYQTSLPAGTYCDVQSNTPVTVNGSGQFTATLGAHTALALHVGAMNCGSGTTTPPPTTPPATPGASFNATATTVVGQDIYVTGNRAELGNWSPAAALKLDPATYPVWKLTVGLPAGTAFEYKYLRKDAAGNVTWESGANRTATVPASGRIVLNDTFRS

SEQ ID NO: 621 - DNA, 1770 bp, Unknown
  Obtained from an environmental sample
atgcaaaacacagcgaaaaactccatctggcagagggtgcgccacagcgccattgccttatccgctctcagcttatcctttggcctgcaggccagcgagttaccacaaattccaccacagcaggtgaacaacaccatgtaccaggcattttattgggatgcctaccctggcctttgggccaatttaccggccatggcggcccctttggccgaacggggcattacctcgatgtggttgccgcccgccgccaaaggcatgaatggtactttcagtgtcggttacgatgtatacgatttctgggatctgggcgagtttaaccaaaaaggcaccaccgccacccgttacggtactcgtcagcagctgcaacaagcactgagtgctctggaccaactgggtattcaggcctattttgatgtggtgtttaaccaccgcatgggcgccgatgcacaggagaatattcctggctttggcctggcctggaccgagtatcatctgcaaggtcgtcaggcgcattatacccagcaaaactggggctacttgtggcacgactttgactggaactggaccgcgtttaatggctccgacaatcagctctaccccggcaaatggtggggcaataccttccacttcccttatttgatgggtgaggatgtcgattacaaccgctttgaagtgcagcaggaaatgaaagcctggggcgagtggatcatcaacagcgttggctttagcggctttcggatggacgccatcgcacacgtggataccgattttacccgtgactggatcaatcacgtacagtgggccaccagcgaggatgtattctttgtcgcagaagcctgggtcagtgatatcaacggctatctggatgcagtcaatacgccgcatttgcgcgcttttgatttcaatttgcgcgaagactttgttgctttaagcagtggtggcaaagacatgcgctggtggggtggtctggttaatagccagcaccgtgatcgggcggtcacttttgtcgataaccacgataccagccgggccggcaacccttatggcatgccgcaggtgatcaactacaagaaccaggcctacgcttacattctgttgcgtgagcatggggtgccgactgtgtttgcccgcgattacgacgaatttggcatggcgccaacgctggataaattgattgaggcgcgccgctactttgcctatggtcctggtcatgagtactccggcaataccgaggccgtttacgcctatgtgcgcgaggggcttagcactgtgccgggcaccggtctggtgatgctgatatcgggtcgaaactggggtggtcagcagtcgttcaccatcaacagccatcagccgaataccaccttttacgattataccggcaatgtcagcggcacggtgaccaccaatgcgcagggttatggcagcttcccggtcactatgacggaaagtaccggttggtcagtctgggtaccacaatccagtggtggcactcagccgggatccattaccctgcggatgaccaaggatgttggctatggtttttcactgttcttcactggcagcagtgcagagctcaccaattggggcggcggtattgaaggcacctggaccagtggccatgtctgggaagtgaccatcccggatccgggcaactttgaatggaaaacccgtaaaggcccaaccggcggcagtggtcaggactgggaaagtggtagcaaccacaatcagaccaatttgcaccccagttttaatggtgggtttagatctcgc

SEQ ID NO: 622 - protein, 590 aa, Unknown
  Obtained from an environmental sample
  SIGNAL (1)...(31)
  DOMAIN (44)...(395): Alpha amylase, catalytic domain
MQNTAKNSIWQRVRHSAIALSALSLSFGLQASELPQIPPQQVNNTMYQAFYWDAYPGLWANLPAMAAPLAERGITSMWLPPAAKGMNGTFSVGYDVYDFWDLGEFNQKGTTATRYGTRQQLQQALSALDQLGIQAYFDVVFNHRMGADAQENIPGFGLAWTEYHLQGRQAHYTQQNWGYLWHDFDWNWTAFNGSDNQLYPGKWWGNTFHFPYLMGEDVDYNRFEVQQEMKAWGEWIINSVGFSGFRMDAIAHVDTDFTRDWINHVQWATSEDVFFVAEAWVSDINGYLDAVNTPHLRAFDFNLREDFVALSSGGKDMRWWGGLVNSQHRDRAVTFVDNHDTSRAGNPYGMPQVINYKNQAYAYILLREHGVPTVFARDYDEFGMAPTLDKLIEARRYFAYGPGHEYSGNTEAVYAYVREGLSTVPGTGLVMLISGRNWGGQQSFTINSHQPNTTFYDYTGNVSGTVTTNAQGYGSFPVTMTESTGWSVWVPQSSGGTQPGSITLRMTKDVGYGFSLFFTGSSAELTNWGGGIEGTWTSGHVWEVTIPDPGNFEWKTRKGPTGGSGQDWESGSNHNQTNLHPSFNGGFRSR

What is claimed is:

1. An isolated, synthetic, or recombinant polypeptide having alpha-amylase activity comprising:
   (a) an amino acid sequence having at least 90% sequence identity to the sequence SEQ ID NO: 419, or a fragment thereof having alpha-amylase activity; or
   (b) the polypeptide of (a) lacking a signal sequence.

2. A protein preparation comprising the polypeptide of claim 1, wherein the protein preparation comprises a liquid, a solid or a gel.

3. A fusion protein comprising
   the polypeptide of claim 1 and a second domain.

4. An immobilized polypeptide, wherein the polypeptide comprises
   a sequence as set forth in claim 1.

5. An array comprising an immobilized polypeptide of claim 1.

6. A composition comprising the polypeptide of claim 1.

7. A food, feed, food supplement or feed supplement for an animal, an edible material or an edible enzyme delivery matrix, comprising the polypeptide of claim 1.

8. A food supplement, feed supplement, feed or a food comprising the polypeptide of claim 1.

9. A detergent composition comprising the polypeptide of claim 1.

10. A high-maltose or a high-glucose liquid or syrup comprising the polypeptide of claim 1.

11. An alcoholic beverage comprising the polypeptide of claim 1.

12. A beer comprising the polypeptide of claim 1.

13. An oral care product comprising the polypeptide of claim 1.

14. A delayed release or controlled release composition comprising
   the polypeptide of claim 1.

15. The isolated, synthetic, or recombinant polypeptide of claim 1, wherein the polypeptide comprises at least one glycosylation site.

16. A method for hydrolyzing a starch, or removing or liquefying the starch, comprising the following steps:
   (a) providing a polypeptide having alpha amylase activity, wherein the polypeptide comprises the polypeptide of claim 1;
   (b) providing a composition comprising starch; and
   (c) contacting the polypeptide of step (a) with the composition of step (b) under conditions wherein the polypeptide hydrolyzes the starch, or removes or liquefies the starch.

17. A method for hydrolyzing starch in a food supplement or feed supplement, or a feed or a food prior to consumption by an animal comprising the following steps:
   (a) obtaining a feed or food material, or a food supplement or feed supplement, comprising starch, wherein the starch can be hydrolyzed by a polypeptide having alpha-amylase activity, wherein the polypeptide comprises the polypeptide of claim 1; and
   (b) adding the polypeptide of step (a) to the feed or food material, or food supplement or feed supplement, in an amount sufficient for a sufficient time period to cause hydrolysis of the starch and formation of a treated food or feed food supplement or feed supplement, thereby hydrolyzing the starch in the food supplement, feed supplement, food or the feed prior to consumption by the animal.

18. A method for producing a high-maltose or a high-glucose syrup comprising the following steps:
   (a) providing a polypeptide having alpha amylase activity, wherein the polypeptide comprises the polypeptide of claim 1;
   (b) providing a composition comprising a starch; and
   (c) contacting the polypeptide of step (a) and the composition of step (b) under conditions wherein the polypeptide of step (a) can hydrolyze the composition of step (b), thereby producing a high-maltose or a high-glucose syrup.

19. A method for washing an object comprising the following steps:
   (a) providing a composition comprising a polypeptide having alpha amylase activity, wherein the polypeptide comprises the polypeptide of claim 1;
   (b) providing an object; and
   (c) contacting the polypeptide of step (a) and the object of step (b) under conditions wherein the composition can wash the object.

20. A method for using amylase in brewing or alcohol production comprising the following steps:
   (a) providing a polypeptide comprising the polypeptide of claim 1;
   (b) providing a composition used for brewing or in alcohol production comprising starch; and
   (c) combining the polypeptide of step (a) with the composition of the step (b) under conditions wherein the polypeptide can hydrolyze the starch in the composition used for brewing or alcohol production.

21. A method for producing a food or feed comprising a alpha amylase, the method comprising the steps of:
   (a) providing a polypeptide having alpha-amylase activity, wherein the polypeptide comprises the polypeptide of claim 1;
   (b) providing a composition comprising a food or feed; and
   (c) mixing the alpha-amylase and the feed-comprising composition, thereby producing a food or feed comprising a alpha amylase.

* * * * *